US007115727B2

(12) United States Patent
Faris et al.

(10) Patent No.: US 7,115,727 B2
(45) Date of Patent: Oct. 3, 2006

(54) NUCLEIC ACIDS AND CORRESPONDING PROTEINS ENTITLED 282P1G3 USEFUL IN TREATMENT AND DETECTION OF CANCER

(75) Inventors: Mary Faris, Los Angeles, CA (US); Pia M. Challita-Eid, Encino, CA (US); Aya Jakobovits, Beverly Hills, CA (US); Arthur B. Raitano, Los Angeles, CA (US); Wangmao Ge, Culver City, CA (US)

(73) Assignee: Agensys, Inc., Santa Monica, CA (US)

( * ) Notice: Subject to any disclaimer, the term of this patent is extended or adjusted under 35 U.S.C. 154(b) by 442 days.

(21) Appl. No.: 10/435,751

(22) Filed: May 9, 2003

(65) Prior Publication Data

US 2004/0053348 A1 Mar. 18, 2004

Related U.S. Application Data

(60) Provisional application No. 60/423,290, filed on Nov. 1, 2002, provisional application No. 60/404,306, filed on Aug. 16, 2002.

(51) Int. Cl.
*C07H 21/02* (2006.01)

(52) U.S. Cl. ........................ 536/23.1; 435/6; 435/320.1

(58) Field of Classification Search ..................... None
See application file for complete search history.

(56) References Cited

U.S. PATENT DOCUMENTS

| | | | |
|---|---|---|---|
| 6,476,212 | B1 | 11/2002 | Lalgudi et al. |
| 6,576,607 | B1 | 6/2003 | Schachner |
| 6,682,888 | B1 | 1/2004 | Loring et al. |
| 2004/0022790 | A1 | 2/2004 | Schachner |

FOREIGN PATENT DOCUMENTS

| | | |
|---|---|---|
| DE | 20103510 | 6/2001 |
| EP | 1 394 274 | 3/2004 |
| EP | 1 447 413 | 8/2004 |
| WO | WO-93/16178 | 8/1993 |
| WO | WO-96/32959 | 10/1996 |
| WO | WO-98/45435 | 10/1998 |
| WO | WO-00/58357 | 10/2000 |
| WO | WO-01/55206 | 8/2001 |
| WO | WO-01/55314 | 8/2001 |
| WO | WO-01/57272 | 8/2001 |
| WO | WO-01/57273 | 8/2001 |
| WO | WO-01/57274 | 8/2001 |
| WO | WO-01/57275 | 8/2001 |

(Continued)

OTHER PUBLICATIONS

Greenbaum et al., Genome Biology, 2003, vol. 4 (9), pp. 117.1-117.8.*

(Continued)

*Primary Examiner*—Larry Helms
*Assistant Examiner*—Hong Sang
(74) *Attorney, Agent, or Firm*—Morrison & Foerster LLP

(57) ABSTRACT

A novel gene 282P1G3 and its encoded protein, and variants thereof, are described wherein 282P1G3 exhibits tissue specific expression in normal adult tissue, and is aberrantly expressed in the cancers listed in Table I. Consequently, 282P1G3 provides a diagnostic, prognostic, prophylactic and/or therapeutic target for cancer. The 282P1G3 gene or fragment thereof, or its encoded protein, or variants thereof, or a fragment thereof, can be used to elicit a humoral or cellular immune response; antibodies or T cells reactive with 282P1G3 can be used in active or passive immunization.

3 Claims, 109 Drawing Sheets

282P1G3 SSH sequence of 321 nucleotides. (SEQ ID NO: 1)

```
  1 GATCGCGTTT CGGAGGCGGC GCAGTTTCCA GGTTAACTAA GGTCTCAGCT GTAAACCAAA
 61 AGTGAGAGGA GACATTAAGA TTTTCATTCT TACCGGGTTG TCTTCTTCCT GAAGAGCAAT
121 GGAGCCGCTT TTACTTGGAA GAGGACTAAT CGTATATCTA ATGTTCCTCC TGTTAAAATT
181 CTCAAAAGCA ATTGAAATAC CATCTTCAGT TCAACAGGTT CCAACAATCT TAAAACAGTC
241 AAAAGTCCAA GTTGCCTTTC CCTTCGATGA GTATTTTCAA ATTGAATGTG AAGCTAAAGG
301 AAATCCAGAA CCAACATTTT C
```

FOREIGN PATENT DOCUMENTS

| | | |
|---|---|---|
| WO | WO-01/57276 | 8/2001 |
| WO | WO-01/57277 | 8/2001 |
| WO | WO-01/57278 | 8/2001 |
| WO | WO-01/66719 | 9/2001 |
| WO | WO-01/75067 | 10/2001 |
| WO | WO-01/86003 | 11/2001 |
| WO | WO-01/92581 | 12/2001 |
| WO | WO-02/10449 | 2/2002 |
| WO | WO-02/18632 | 3/2002 |
| WO | WO-03/016475 | 2/2003 |
| WO | WO-03/068268 | 8/2003 |
| WO | WO-03/080795 | 10/2003 |
| WO | WO-03/087768 | 10/2003 |
| WO | WO-04/016734 | 2/2004 |
| WO | WO-04/023973 | 3/2004 |
| WO | WO-04/028479 | 4/2004 |
| WO | WO-04/048938 | 6/2004 |
| WO | WO-04/066948 | 8/2004 |

OTHER PUBLICATIONS

Alberts et al. Molecular Biology of the Cell, 3rd Edition, 1994, p. 465.*
Mallampalli et al., Biochem. J. 1996, vol. 38, pp. 333-341.*
Fu et al., EMBO journal, 1996, vol. 15, pp. 4392-4402.*

* cited by examiner

Fig. 1: 282P1G3 SSH sequence of 321 nucleotides. (SEQ ID NO: 1)

1 GATCGCGTTT CGGAGGCGGC GCAGTTTCCA GGTTAACTAA GGTCTCAGCT GTAAACCAAA
61 AGTGAGAGGA GACATTAAGA TTTTCATTCT TACCGGGTTG TCTTCTTCCT GAAGAGCAAT
121 GGAGCCGCTT TTACTTGGAA GAGGACTAAT CGTATATCTA ATGTTCCTCC TGTTAAAATT
181 CTCAAAAGCA ATTGAAATAC CATCTTCAGT TCAACAGGTT CCAACAATCT TAAAACAGTC
241 AAAAGTCCAA GTTGCCTTTC CCTTCGATGA GTATTTTCAA ATTGAATGTG AAGCTAAAGG
301 AAATCCAGAA CCAACATTTT C

Fig. 2:

Fig. 2A-1. The cDNA (SEQ ID. NO.: 2) and amino acid sequence (SEQ ID. NO.: 3) of 282P1G3 v.1. The Kozak initiation sequence is shown in bold, and the start methionine is underlined. The open reading frame extends from nucleic acid 272-3946 including the stop codon.

1 cggaccctgcgcgcccccgtcccggctcccggccggctcgggggagaaggcgcccgaggg 61 gaggcgccggacagatcgcgtttcggaggcggcgcaggtgctgtaaactgcaaaccataa 121 tcctgtcttaatactgcaaacaaatcatagtggaactaaggggaacttaatttactgttt 181 ccaggttaactaaggtctcagctgtaaaccaaaagtgagaggagacattaagattttcat

1 M E P L L L G R G L 241 tcttaccgggttgtcttcttcctgaagagcaATGGAGCCGCTTTTACTTGGAAGAGGACT

11 I V Y L M F L L L K F S K A I E I P S S

301 AATCGTATATCTAATGTTCCTCCTGTTAAAATTCTCAAAAGCAATTGAAATACCATCTTC

31 V Q Q V P T I I K Q S K V Q V A F P F D

361 AGTTCAACAGGTTCCAACAATCATAAAACAGTCAAAAGTCCAAGTTGCCTTTCCCTTCGA

51 E Y F Q I E C E A K G N P E P T F S W T

421 TGAGTATTTTCAAATTGAATGTGAAGCTAAAGGAAATCCAGAACCAACATTTTCGTGGAC

71 K D G N P F Y F T D H R I I P S N N S G

481 TAAGGATGGCAACCCTTTTTATTTCACTGACCATCGGATAATTCCATCGAACAATTCAGG

91 T F R I P N E G H I S H F Q G K Y R C F

541 AACATTCAGGATCCCAAACGAGGGGCACATATCTCACTTTCAAGGGAAATACCGCTGCTT

111 A S N K L G I A M S E E I E F I V P S V

601 TGCTTCAAATAAACTGGGAATCGCTATGTCAGAAGAAATAGAATTTATAGTTCCAAGTGT

131 P K L P K E K I D P L E V E E G D P I V

661 TCCAAAACTCCCAAAAGAAAAAATTGACCCTCTTGAAGTGGAGGAGGGAGATCCAATTGT

151 L P C N P P K G L P P L H I Y W M N I E

721 CCTCCCATGCAATCCTCCCAAAGGCCTCCCACCTTTACACATTTATTGGATGAATATTGA

171 L E H I E Q D E R V Y M S Q K G D L Y F

781 ATTAGAACACATCGAACAAGATGAAAGAGTATACATGAGCCAAAAGGGAGATCTATACTT

191 A N V E E K D S R N D Y C C F A A F P R

841 CGCAAACGTGGAAGAAAAGGACAGTCGCAATGACTACTGTTGCTTTGCTGCATTTCCAAG

211 L R T I V Q K M P M K L T V N S L K H A

901 ATTAAGGACTATTGTACAGAAAATGCCAATGAAACTAACAGTTAACAGTTTAAAGCATGC

231 N D S S S S T E I G S K A N S I K Q R K

961 TAATGACTCAAGTTCATCCACAGAAATTGGTTCCAAGGCAAATTCCATCAAGCAAAGAAA

251 P K L L L P P T E S G S E S S I T I L K

1021 ACCCAAACTGCTGTTGCCTCCCACTGAGAGTGGCAGTGAGTCTTCAATTACCATCCTCAA

271 G E I L L L E C F A E G L P T P Q V D W

1081 AGGGGAAATCTTGCTGCTTGAGTGTTTTGCTGAAGGCTTGCCAACTCCACAGGTTGATTG

291 N K I G G D L P K G R E T K E N Y G K T

1141 GAACAAAATTGGTGGTGACTTACCAAAGGGGAGAGAAACAAAAGAAAATTATGGCAAGAC

```
1201 TTTGAAGATAGAGAATGTCTCCTACCAGGACAAAGGAAATTATCGCTGCACAGCCAGCAA
 331  F   L   G   T   A   T   H   D   F   H   V   I   V   E   E   P   P   R   W   T
1261 TTTCTTGGGAACAGCCACTCACGATTTTCACGTTATAGTAGAAGAGCCTCCTCGCTGGAC
 351  K   K   P   Q   S   A   V   Y   S   T   G   S   N   G   I   L   L   C   E   A
1321 AAAGAAGCCTCAGAGTGCTGTGTATAGCACCGGAAGCAATGGCATCTTGTTATGTGAGGC
 371  E   G   E   P   Q   P   T   I   K   W   R   V   N   G   S   P   V   D   N   H
1381 TGAAGGAGAACCTCAACCCACAATCAAGTGGAGAGTCAATGGCTCCCCAGTTGACAATCA
 391  P   F   A   G   D   V   V   F   P   R   E   I   S   F   T   N   L   Q   P   N
1441 TCCATTTGCTGGTGATGTTGTCTTCCCCAGGGAAATCAGTTTTACCAACCTTCAACCAAA
 411  H   T   A   V   Y   Q   C   E   A   S   N   V   H   G   T   I   L   A   N   A
1501 TCATACTGCTGTGTACCAGTGTGAAGCCTCAAATGTCCATGGAACTATCCTTGCCAATGC
 431  N   I   D   V   V   D   V   R   P   L   I   Q   T   K   D   G   E   N   Y   A
1561 CAATATTGATGTTGTGGATGTCCGTCCATTGATACAAACCAAAGATGGAGAAAATTACGC
 451  T   V   V   G   Y   S   A   F   L   H   C   E   F   F   A   S   P   E   A   V
1621 TACAGTGGTTGGGTACAGTGCTTTCTTACATTGCGAGTTCTTTGCTTCACCTGAGGCAGT
 471  V   S   W   Q   K   V   E   E   V   K   P   L   E   G   R   R   Y   H   I   Y
1681 CGTGTCCTGGCAGAAGGTGGAAGAAGTGAAACCCCTGGAGGGCAGGCGGTATCATATCTA
 491  E   N   G   T   L   Q   I   N   R   T   T   E   E   D   A   G   S   Y   S   C
1741 TGAAAATGGCACATTGCAGATCAACAGAACCACCGAAGAAGATGCTGGGTCTTACTCATG
 511  W   V   E   N   A   I   G   K   T   A   V   T   A   N   L   D   I   R   N   A
1801 TTGGGTAGAAAATGCTATAGGAAAAACTGCAGTCACAGCCAATTTGGATATTAGAAATGC
 531  T   K   L   R   V   S   P   K   N   P   R   I   P   K   L   H   M   L   E   L
1861 TACAAAACTTAGAGTTTCTCCTAAGAATCCTCGTATCCCCAAATTGCATATGCTTGAATT
 551  H   C   E   S   K   C   D   S   H   L   K   H   S   L   K   L   S   W   S   K
1921 ACATTGTGAAAGCAAATGTGACTCACATTTGAAACACAGTTTGAAGTTGTCCTGGAGTAA
 571  D   G   E   A   F   E   I   N   G   T   E   D   G   R   I   I   I   D   G   A
1981 AGATGGAGAAGCCTTTGAAATTAATGGCACAGAAGATGGCAGGATAATTATTGATGGAGC
 591  N   L   T   I   S   N   V   T   L   E   D   Q   G   I   Y   C   C   S   A   H
2041 TAATTTGACCATATCTAATGTAACTTTAGAGGACCAAGGTATTTACTGCTGTTCAGCTCA
 611  T   A   L   D   S   A   A   D   I   T   Q   V   T   V   L   D   V   P   D   P
2101 TACTGCTCTAGACAGTGCTGCCGATATAACTCAAGTAACTGTTCTTGATGTTCCGGATCC
 631  P   E   N   L   H   L   S   E   R   Q   N   R   S   V   R   L   T   W   E   A
2161 ACCAGAAAACCTTCACTTGTCTGAAAGACAGAACAGGAGTGTTCGGCTGACCTGGGAAGC
 651  G   A   D   H   N   S   N   I   S   E   Y   I   V   E   F   E   G   N   K   E
2221 TGGAGCTGACCACAACAGCAATATTAGCGAGTATATTGTTGAATTTGAAGGAAACAAAGA
 671  E   P   G   R   W   E   E   L   T   R   V   Q   G   K   K   T   T   V   I   L
2281 AGAGCCTGGAAGGTGGGAGGAACTGACCAGAGTCCAAGGAAAGAAAACCACAGTTATCTT
 691  P   L   A   P   F   V   R   Y   Q   F   R   V   I   A   V   N   E   V   G   R
2341 ACCTTTGGCTCCATTTGTGAGATACCAGTTCAGGGTCATAGCCGTGAACGAAGTAGGGAG
 711  S   Q   P   S   Q   P   S   D   H   H   E   T   P   P   A   A   P   D   R   N
2401 AAGTCAGCCTAGCCAGCCGTCAGACCATCATGAAACACCACCAGCAGCTCCAGATAGGAA
```

Fig. 2A-3

```
731  P Q N I R V Q A S Q P K E M I I K W E P
2461 TCCACAAAACATAAGGGTTCAAGCCTCTCAACCCAAGGAAATGATTATAAAGTGGGAGCC
751  L K S M E Q N G P G L E Y R V T W K P Q
2521 TTTGAAATCCATGGAGCAGAATGGACCAGGCCTAGAGTACAGAGTGACCTGGAAGCCACA
771  G A P V E W E E E T V T N H T L R V M T
2581 GGGAGCCCCAGTGGAGTGGGAAGAAGAAACAGTCACAAACCACACATTGCGGGTGATGAC
791  P A V Y A P Y D V K V Q A I N Q L G S G
2641 GCCTGCTGTCTATGCCCCTTATGATGTCAAGGTCCAGGCTATCAATCAACTAGGATCTGG
811  P D P Q S V T L Y S G E D Y P D T A P V
2701 GCCTGACCCTCAGTCAGTGACTCTCTATTCTGGAGAAGACTATCCTGATACAGCTCCAGT
831  I H G V D V I N S T L V K V T W S T V P
2761 GATCCATGGGGTGGACGTTATAAACAGTACATTAGTTAAAGTTACCTGGTCAACAGTTCC
851  K D R V H G R L K G Y Q I N W W K T K S
2821 AAAGGACAGAGTACATGGACGTCTGAAAGGCTATCAGATAAATTGGTGGAAAACAAAAAG
871  L L D G R T H P K E V N I L R F S G Q R
2881 TCTGTTGGATGGAAGAACACATCCCAAAGAAGTGAACATTCTAAGATTTTCAGGACAAAG
891  N S G M V P S L D A F S E F H L T V L A
2941 AAACTCTGGAATGGTTCCTTCCTTAGATGCCTTTAGTGAATTTCATTTAACAGTCTTAGC
911  Y N S K G A G P E S E P Y I F Q T P E G
3001 CTATAACTCTAAAGGAGCTGGTCCTGAAAGTGAGCCTTATATATTTCAAACACCAGAAGG
931  V P E Q P T F L K V I K V D K D T A T L
3061 AGTACCTGAACAGCCAACTTTTCTAAAGGTCATCAAAGTTGATAAAGACACTGCCACTTT
951  S W G L P K K L N G N L T G Y L L Q Y Q
3121 ATCTTGGGGACTACCTAAGAAATTAAATGGAAACTTAACTGGCTATCTTTTGCAATATCA
971  I I N D T Y E I G E L N D I N I T T P S
3181 GATAATAAATGACACCTACGAGATTGGAGAATTAAATGATATTAACATTACAACTCCATC
991  K P S W H L S N L N A T T K Y K F Y L R
3241 AAAGCCCAGCTGGCACCTCTCAAACCTGAATGCAACTACCAAGTACAAATTCTACTTGAG
1011 A C T S Q G C G K P I T E E S S T L G E
3301 GGCTTGCACTTCACAGGGCTGTGGAAAACCGATCACGGAGGAAAGCTCCACCTTAGGAGA
1031 G S K G I G K I S G V N L T Q K T H P I
3361 AGGGAGTAAAGGTATCGGGAAGATATCAGGAGTAAATCTTACTCAAAAGACTCACCCAAT
1051 E V F E P G A E H I V R L M T K N W G D
3421 AGAGGTATTTGAGCCGGGAGCTGAACATATAGTTCGCCTAATGACTAAGAATTGGGGCGA
1071 N D S I F Q D V I E T R G R E Y A G L Y
3481 TAACGATAGCATTTTTCAAGATGTAATTGAGACAAGAGGGAGAGAATATGCTGGTTTATA
1091 D D I S T Q G W F I G L M C A I A L L T
3541 TGATGACATCTCCACTCAAGGCTGGTTTATTGGACTGATGTGTGCGATTGCTCTTCTCAC
1111 L L L L T V C F V K R N R G G K Y S V K
3601 ACTACTATTATTAACTGTTTGCTTTGTGAAGAGGAATAGAGGTGGAAAGTACTCAGTTAA
1131 E K E D L H P D P E I Q S V K D E T F G
```

Fig. 2A-4

```
3661 AGAAAAGGAAGATTTGCATCCAGACCCAGAAATTCAGTCAGTAAAAGATGAAACCTTTGG
1151  E  Y  S  D  S  D  E  K  P  L  K  G  S  L  R  S  L  N  R  D
3721 TGAATACAGTGACAGTGATGAAAAGCCTCTCAAAGGAAGCCTTCGGTCCCTTAATAGGGA
1171  M  Q  P  T  E  S  A  D  S  L  V  E  Y  G  E  G  D  H  G  L
3781 TATGCAGCCTACTGAAAGTGCTGACAGCTTAGTCGAATACGGAGAGGGAGACCATGGTCT
1191  F  S  E  D  G  S  F  I  G  A  Y  A  G  S  K  E  K  G  S  V
3841 CTTCAGTGAAGATGGATCATTTATTGGTGCCTACGCTGGATCTAAGGAGAAGGGATCTGT
1211  E  S  N  G  S  S  T  A  T  F  P  L  R  A  *
3901 TGAAAGCAATGGAAGTTCTACAGCAACTTTTCCCCTTCGGGCATAAacacaacatatgta
3961 agcaacgctactggttcaccccaaccttccatatttatctgttcaaaggagcaagaactt
4021 tcatataggaatagaaacatgctggccgaagatttcatccagaagtcaacatcctgcaat
4081 tatgttgaaaagagtagtactttcttcaaaatataaaatgccaagcacttcaggcctatg
4141 ttttgcttatattgttttcaggtgctcaaaatgcaaaacacaaaacaaatcctgcattta
4201 gatacacctcaactaaatccaaagtccccattcagtatattccatatttgcctgatttta
4261 ctattcggtgtgtttgcatagatgttgctacttggtgggtttttctccgtatgcacattg
4321 gtatacagtctctgagaactggcttggtgactttgcttcactacaggttaaaagaccata
4381 agcaaactggttatttaaaatgtaaaaaggaatatgaaagtcttattaaaacacttcatt
4441 gaaaatatacagtctaaatttattatttaaattttactagcaaaagtcttaggtgaacaa
4501 tcaactagtatttgttgagctcctatttgcccagagatggtcatatttaaacagaagtat
4561 acgtttttcagtttcaacatgaatttttttatttctgtcagttatgacatccacgagcat
4621 cactttttgtgtctgttttttttttttttcttggactaaattcaactgcatggaagcggtg
4681 gtcagaaggttgttttatacgagaacaggcagaaagtgcccattgttcaggattctaata
4741 gctacatctacttaatatcttcatttctaaattgactgcttttacctttttctcatgttt
4801 atataatggtatgcttgcatatatttcatgaatacattgtacatattatgttaatattta
4861 cacaatttaaaatatagatgtgttttattttgaagtgagaaaatgaacattaacaggcat
4921 gtttgtacagctagaatatattagtaagatactgtttttcgtcattccagagctacaact
4981 aataacacgaggttccaaagctgaagactttgtataaagtatttgggttttgttcttgta
5041 ttgctttctttcaacagtttcaaaataaaatatcatacaaatattgagggaaatgttttc
5101 atatttttcaaaataggtttttattgttgaatgtacatctaccccagcccctcaaaagaa
5161 aaactgtttacatagaaattcctacacatacgtttgcgtatatgttattttaaacatctt
5221 tgtggtgagaatttttttccccgatattctccttctgtcaaagtcagaacaaattcaggga
5281 atttattttctggcagttgtgctccagtccttttaaaattgtacatgaacatgttttaga
5341 aacaatatggaggatgatgcatacatgtcggtcaagttcagcgctcgacattttatggaa
5401 agatttttttaaccttaccacgaaatacttaactactgtttaagtgaattgacttatttc
5461 actttagtttttgaactgtgattattggtatactgttatatcctcaacttggatttatgg
5521 taacccctttttagttcatggagaccaaaatttggggtatttataatagtcagcgcaggaa
5581 tgcacatggaatatctacttgtccttttgaacctcacgagtcatccagaatgtatagaca
5641 ggaaaagcatgtcttatttaaaactgtaatttatgggctcaggatctgaccgcagtcccg
5701 ggagtaagcatttcaaagggggaaggcagtgtggtccctaccctgtgtgaatgtgaggat
5761 gtagacatccatcagtgcaactcgagctccatcctcctccgatttctaaggctccagttt
5821 tctggagggacagtcatcatgttttgatttatctgggagaaaactgtggtgcacagcttg
```

Fig. 2A-5

```
5881 tgaggagggcaaggttgtgacgttcgagcttagttctggtgttattctgtctcctcttct
5941 ttgtcatcagccaaaacgtggtttttaaagagagtcatgcaggttagaaataatgtcaaa
6001 aatatttaggaatttaataacctttaagtcagaaactaaaacaaatactgaaatattagc
6061 tcttcctacacttcgtgttcccctttagctgcctgaaaatcaagattgctcctactcaga
6121 tcttctgagtggctaaaacttatggatatgaaaatgagattgaatgatgactatgcttt
6181 gctatcattgttacctttcctcaatactatttggcaactactgggactcttcagcacaaa
6241 aggaatagatctatgattgaccctgattttaattgtgaaattatatgattcatatatttt
6301 atgaatcagaataaccttcaaataaaataaatctaagtcggttaaaatggatttcatgat
6361 tttccctcagaaaatgagtaacggagtccacggcgtgcaatggtaattataaattggtga
6421 tgcttgtttgcaaattgcccactcgtgataagtcaacagccaatatttaaaactttgttc
6481 gttactggctttaccctaactttctctagtctactgtcaatatcattttaatgtaattga
6541 ttgtatatagtctcaagaatggttggtgggcatgagttcctagagaactgtccaagggtt
6601 gggaaaatccaaattctcttcctggctccagcactgattttgtacataaacattaggcag
6661 gttgcttaaccttttatttcaaactctctcaactctaaagtgctaataataatctcagt
6721 taccttatctttgtcacagggtgttctttttatgaagaaaaatttgaaaatgataaaag
6781 ctaagatgccttctaacttcataagcaaacctttaactaattatgtatctgaaagtcacc
6841 cccacataccaactcaacttttttcctgtgaacacataaatatattttttatagaaaaaca
6901 aatctacataaaataaatctactgtttagtgagcagtatgacttgtacatgccattgaaa
6961 attattaatcagaagaaaattaagcagggtctttgctatacaaaagtgttttccactaat
7021 tttgcatgcgtatttataagaaaaatgtgaatttggtggttttattctatcggtataaag
7081 gcatcgatattttagatgcacccgtgtttgtaaaaatgtagagcacaatggaattatgct
7141 ggaagtctcaaataatatttttttcctattttatactcatggaagagataagctaaagag
7201 gggacaataatgagaaatgttggtgtgcttttctaagcatttaaaacataattgccaatt
7261 gaaaccctaaatatgtttacataccattaagatatgattcatgtaacaatgttaaattaa
7321 ttataatgggattgggtttgttatctgtggtagtatatatcctagtgttcctatagtgaa
7381 ataagtagggttcagccaaagctttctttgttttgtaccttaaattgttcgattacgtca
7441 tcaaaagagatgaaaggtatgtagaacaggttcacgtgattacctttttcttttggcttg
7501 gattaatattcatagtagaactttataaaacgtgtttgtattgtaggtggtgtttgtatt
7561 atgcttatgactatgtatggtttgaaaatattttcattatacatgaaattcaactttcca
7621 aataaaagttctacttcatgtaatccaaaa
```

Fig. 2B-1. The cDNA (SEQ ID. NO. : 4) and amino acid sequence (SEQ ID. NO. : 5) of 282P1G3 v.2 clone VP1-22. The Kozak initiation sequence is shown in bold, and the start methionine is underlined. The open reading frame extends from nucleic acid 272-3787 including the stop codon.

```
  1 cggaccctgcgcgcccccgtcccggctcccggccggctcgggggagaaggcgcccgaggg
 61 gaggcgccggacagatcgcgtttcggaggcggcgcaggtgctgtaaactgcaaaccataa
121 tcctgtcttaatactgcaaacaaatcatagtggaactaagggggaacttaatttactgttt
181 ccaggttaactaaggtctcagctgtaaaccaaaagtgagaggagacattaagattttcat
  1                                        M  E  P  L  L  L  G  R  G  L
241 tcttaccgggttgtcttcttcctgaaga gcaATGGAGCCGCTTTTACTTGGAAGAGGACT
```

Fig. 2B-2

```
  11 I V Y L M F L L L K F S K A I E I P S S
 301 AATCGTATATCTAATGTTCCTCCTGTTAAAATTCTCAAAAGCAATTGAAATACCATCTTC
  31 V Q Q V P T I I K Q S K V Q V A F P F D
 361 AGTTCAACAGGTTCCAACAATCATAAAACAGTCAAAAGTCCAAGTTGCCTTTCCCTTCGA
  51 E Y F Q I E C E A K G N P E P T F S W T
 421 TGAGTATTTTCAAATTGAATGTGAAGCTAAAGGAAATCCAGAACCAACATTTTCGTGGAC
  71 K D G N P F Y F T D H R I I P S N N S G
 481 TAAGGATGGCAACCCTTTTTATTTCACTGACCATCGGATAATTCCATCGAACAATTCAGG
  91 T F R I P N E G H I S H F Q G K Y R C F
 541 AACATTCAGGATCCCAAACGAGGGGCACATATCTCACTTTCAAGGGAAATACCGCTGCTT
 111 A S N K L G I A M S E E I E F I V P S V
 601 TGCTTCAAATAAACTGGGAATCGCTATGTCAGAAGAAATAGAATTTATAGTTCCAAGTGT
 131 P K F P K E K I D P L E V E E G D P I V
 661 TCCAAAATTCCCAAAAGAAAAAATTGACCCTCTTGAAGTGGAGGAGGGAGATCCAATTGT
 151 L P C N P P K G L P P L H I Y W M N I E
 721 CCTCCCATGCAATCCTCCCAAAGGCCTCCCACCTTTACACATTTATTGGATGAATATTGA
 171 L E H I E Q D E R V Y M S Q K G D L Y F
 781 ATTAGAACACATCGAACAAGATGAAAGAGTATACATGAGCCAAAAGGGAGATCTATACTT
 191 A N V E E K D S R N D Y C C F A A F P R
 841 CGCAAACGTGGAAGAAAAGGACAGTCGCAATGACTACTGTTGCTTTGCTGCATTTCCAAG
 211 L R T I V Q K M P M K L T V N S L K H A
 901 ATTAAGGACTATTGTACAGAAAATGCCAATGAAACTAACAGTTAACAGTTTAAAGCATGC
 231 N D S S S S T E I G S K A N S I K Q R K
 961 TAATGACTCAAGTTCATCCACAGAAATTGGTTCCAAGGCAAATTCCATCAAGCAAAGAAA
 251 P K L L L P P T E S G S E S S I T I L K
1021 ACCCAAACTGCTGTTGCCTCCCACTGAGAGTGGCAGTGAGTCTTCAATTACCATCCTCAA
 271 G E I L L L E C F A E G L P T P Q V D W
1081 AGGGGAAATCTTGCTGCTTGAGTGTTTTGCTGAAGGCTTGCCAACTCCACAGGTTGATTG
 291 N K I G G D L P K G R E A K E N Y G K T
1141 GAACAAAATTGGTGGTGACTTACCAAAGGGGAGAGAAGCAAAAGAAAATTATGGCAAGAC
 311 L K I E N V S Y Q D K G N Y R C T A S N
1201 TTTGAAGATAGAGAATGTCTCCTACCAGGACAAAGGAAATTATCGCTGCACAGCCAGCAA
 331 F L G T A T H D F H V I V E E P P R W T
1261 TTTCTTGGGAACAGCCACTCACGATTTTCACGTTATAGTAGAAGAGCCTCCTCGCTGGAC
 351 K K P Q S A V Y S T G S N G I L L C E A
1321 AAAGAAGCCTCAGAGTGCTGTGTATAGCACCGGAAGCAATGGCATCTTGTTATGTGAGGC
 371 E G E P Q P T I K W R V N G S P V D N H
1381 TGAAGGAGAACCTCAACCCACAATCAAGTGGAGAGTCAATGGCTCCCCAGTTGACAATCA
 391 P F A G D V V F P R E I S F T N L Q P N
1441 TCCATTTGCTGGTGATGTTGTCTTCCCCAGGGAAATCAGTTTTACCAACCTTCAACCAAA
 411 H T A V Y Q C E A S N V H G T I L A N A
```

Fig. 2B-3

```
1501 TCATACTGCTGTGTACCAGTGTGAAGCCTCAAATGTCCATGGAACTATCCTTGCCAATGC
 431  N  I  D  V  V  D  V  R  P  L  I  Q  T  K  D  G  E  N  Y  A
1561 CAATATTGATGTTGTGGATGTCCGTCCATTGATACAAACCAAAGATGGAGAAAATTACGC
 451  T  V  V  G  Y  S  A  F  L  H  C  E  F  F  A  S  P  E  A  V
1621 TACAGTGGTTGGGTACAGTGCTTTCTTACATTGCGAGTTCTTTGCTTCACCTGAGGCAGT
 471  V  S  W  Q  K  V  E  E  V  K  P  L  E  G  R  R  Y  H  I  Y
1681 CGTGTCCTGGCAGAAGGTGGAAGAAGTGAAACCCCTGGAGGGCAGGCGGTATCATATCTA
 491  E  N  G  T  L  Q  I  N  R  T  T  E  E  D  A  G  S  Y  S  C
1741 TGAAAATGGCACATTGCAGATCAACAGAACCACCGAAGAAGATGCTGGGTCTTACTCATG
 511  W  V  E  N  A  I  G  K  T  A  V  T  A  N  L  D  I  R  N  A
1801 TTGGGTAGAAAATGCTATAGGAAAAACTGCAGTCACAGCCAATTTGGATATTAGAAATGC
 531  T  K  L  R  V  S  P  K  N  P  R  I  P  K  L  H  M  L  E  L
1861 TACAAAACTTAGAGTTTCTCCTAAGAATCCTCGTATCCCCAAATTGCATATGCTTGAATT
 551  H  C  E  S  K  C  D  S  H  L  K  H  S  L  K  L  S  W  S  K
1921 ACATTGTGAAAGCAAATGTGACTCACATTTGAAACACAGTTTGAAGTTGTCCTGGAGTAA
 571  D  G  E  A  F  E  I  N  G  T  E  D  G  R  I  I  I  D  G  A
1981 AGATGGAGAAGCCTTTGAAATTAATGGCACAGAAGATGGCAGGATAATTATTGATGGAGC
 591  N  L  T  I  S  N  V  T  L  E  D  Q  G  I  Y  C  C  S  A  H
2041 TAATTTGACCATATCTAATGTAACTTTAGAGGACCAAGGTATTTACTGCTGTTCAGCTCA
 611  T  A  L  D  S  A  A  D  I  T  Q  V  T  V  L  D  V  P  D  P
2101 TACTGCTCTAGACAGTGCTGCCGATATAACTCAAGTAACTGTTCTTGATGTTCCGGATCC
 631  P  E  N  L  H  L  S  E  R  Q  N  R  S  V  R  L  T  W  E  A
2161 ACCAGAAAACCTTCACTTGTCTGAAAGACAGAACAGGAGTGTTCGGCTGACCTGGGAAGC
 651  G  A  D  H  N  S  N  I  S  E  Y  I  V  E  F  E  G  N  K  E
2221 TGGAGCTGACCACAACAGCAATATTAGCGAGTATATTGTTGAATTTGAAGGAAACAAAGA
 671  E  P  G  R  W  E  E  L  T  R  V  Q  G  K  K  T  T  V  I  L
2281 AGAGCCTGGAAGGTGGGAGGAACTGACCAGAGTCCAAGGAAAGAAAACCACAGTTATCTT
 691  P  L  A  P  F  V  R  Y  Q  F  R  V  I  A  V  N  E  V  G  R
2341 ACCTTTGGCTCCATTTGTGAGATACCAGTTCAGGGTCATAGCCGTGAACGAAGTAGGGAG
 711  S  Q  P  S  Q  P  S  D  H  H  E  T  P  P  A  A  P  D  R  N
2401 AAGTCAGCCTAGCCAGCCGTCAGACCATCATGAAACACCACCAGCAGCTCCAGATAGGAA
 731  P  Q  N  I  R  V  Q  A  S  Q  P  K  E  M  I  I  K  W  E  P
2461 TCCACAAAACATAAGGGTTCAAGCCTCTCAACCCAAGGAAATGATTATAAAGTGGGAGCC
 751  L  K  S  M  E  Q  N  G  P  G  L  E  Y  R  V  T  W  K  P  Q
2521 TTTGAAATCCATGGAGCAGAATGGACCAGGCCTAGAGTACAGAGTGACCTGGAAGCCACA
 771  G  A  P  V  E  W  E  E  E  T  V  T  N  H  T  L  R  V  M  T
2581 GGGAGCCCCAGTGGAGTGGGAAGAAGAAACAGTCACAAACCACACATTGCGGGTGATGAC
 791  P  A  V  Y  A  P  Y  D  V  K  V  Q  A  I  N  Q  L  G  S  G
2641 GCCTGCTGTCTATGCCCCTTATGATGTCAAGGTCCAGGCTATCAATCAACTAGGATCTGG
 811  P  D  P  Q  S  V  T  L  Y  S  G  E  D  Y  P  D  T  A  P  V
2701 GCCTGACCCTCAGTCAGTGACTCTCTATTCTGGAGAAGACTATCCTGATACAGCTCCAGT
```

Fig. 2B-4

```
831  I H G V D V I N S T L V K V T W S T V P
2761 GATCCATGGGGTGGACGTTATAAACAGTACATTAGTTAAAGTTACCTGGTCAACAGTTCC
851  K D R V H G R L K G Y Q I N W W K T K S
2821 AAAGGACAGAGTACATGGACGTCTGAAAGGCTATCAGATAAATTGGTGGAAAACAAAAAG
871  L L D G R T H P K E V N I L R F S G Q R
2881 TCTGTTGGATGGAAGAACACATCCCAAAGAAGTGAACATTCTAAGATTTTCAGGACAAAG
891  N S G M V P S L D A F S E F H L T V L A
2941 AAACTCTGGAATGGTTCCTTCCTTAGATGCCTTTAGTGAATTTCATTTAACAGTCTTAGC
911  Y N S K G A G P E S E P Y I F Q T P E G
3001 CTATAACTCTAAAGGAGCTGGTCCTGAAAGTGAGCCTTATATATTTCAAACACCAGAAGG
931  V P E Q P T F L K V I K V D K D T A T L
3061 AGTACCTGAACAGCCAACTTTTCTAAAGGTCATCAAAGTTGATAAAGACACTGCCACTTT
951  S W G L P K K L N G N L T G Y L L Q Y Q
3121 ATCTTGGGGACTACCTAAGAAATTAAATGGAAACTTAACTGGCTATCTTTTGCAATATCA
971  I I N D T Y E I G E L N D I N I T T P S
3181 GATAATAAATGACACCTACGAGATTGGAGAATTAAATGATATTAACATTACAACTCCATC
991  K P S W H L S N L N A T T K Y K F Y L R
3241 AAAGCCCAGCTGGCACCTCTCAAACCTGAATGCAACTACCAAGTACAAATTCTACTTGAG
1011 A C T S Q G C G K P I T E E S S T L G E
3301 GGCTTGCACTTCACAGGGCTGTGGAAAACCGATCACGGAGGAAAGCTCCACCTTAGGAGA
1031 G K Y A G L Y D D I S T Q G W F I G L M
3361 AGGGAAATATGCTGGTTTATATGATGACATCTCCACTCAAGGCTGGTTTATTGGACTGAT
1051 C A I A L L T L L L L T V C F V K R N R
3421 GTGTGCGATTGCTCTTCTCACACTACTATTATTAACTGTTTGCTTTGTGAAGAGGAATAG
1071 G G K Y S V K E K E D L H P D P E I Q S
3481 AGGTGGAAAGTACTCAGTTAAAGAAAAGGAAGATTTGCATCCAGACCCAGAAATTCAGTC
1091 V K D E T F G E Y S D S D E K P L K G S
3541 AGTAAAAGATGAAACCTTTGGTGAATACAGTGACAGTGATGAAAAGCCTCTCAAAGGAAG
1111 L R S L N R D M Q P T E S A D S L V E Y
3601 CCTTCGGTCCCTTAATAGGGATATGCAGCCTACTGAAAGTGCTGACAGCTTAGTCGAATA
1131 G E G D H G L F S E D G S F I G A Y A G
3661 CGGAGAGGGAGACCATGGTCTCTTCAGTGAAGATGGATCATTTATTGGTGCCTACGCTGG
1151 S K E K G S V E S N G S S T A T F P L R
3721 ATCTAAGGAGAAGGGATCTGTTGAAAGCAATGGAAGTTCTACAGCAACTTTTCCCCTTCG
1171 A *
3781 GGCATAAacacaacatatgtaagcaacgctactggttcaccccaaccttccatatttatc
3841 tgttcaaaggagcaagaactttcatataggaatagaaacatgctggccgaagatttcatc
3901 cagaagtcaacatcctgcaattatgttgaaaagagtagtactttcttcaaaatataaaat
3961 gccaagcacttcaggcctatgttttgcttatattgttttcaggtgctcaaaatgcaaaac
4021 acaaaacaaatcctgcatttagatacacctcaactaaatccaaagtccccattcagtata
4081 ttccatatttgcctgattttactattcggtgtgtttgcatagatgttgctacttggtggg
```

Fig. 2B-5

```
4141 ttttctccgtatgcacattggtatacagtctctgagaactggcttggtgactttgcttc
4201 actacaggttaaaagaccataagcaaactggttatttaaaatgtaaaaaggaatatgaaa
4261 gtcttattaaaacacttcattgaaaatatacagtctaaatttattatttaaattttacta
4321 gcaaaagtcttaggtgaacaatcaactagtatttgttgagctcctatttgcccagagatg
4381 gtcatatttaaacagaagtatacgttttcagtttcaacatgaatttttttatttctgtc
4441 agttatgacatccacgagcatcacttttgtgtctgtttttttttttttcttggactaaa
4501 ttcaactgcatggaagcggtggtcagaaggttgttttatacgagaacaggcagaaagtgc
4561 ccattgttcaggattctaatagctacatctacttaatatcttcatttctaaattgactgc
4621 ttttaccttttctcatgtttatataatggtatgcttgcatatatttcatgaatacattg
4681 tacatattatgttaatatttacacaatttaaaatatagatgtgttttattttgaagtgag
4741 aaaatgaacattaacaggcatgtttgtacagctagaatatattagtaagatactgttttt
4801 cgtcattccagagctacaactaataacacgaggttccaaagctgaagactttgtataaag
4861 tatttgggttttgttcttgtattgcttctttcaacagtttcaaaataaaatatcataca
4921 aatattgagggaaatgttttcatattttcaaaataggtttttattgttgaatgtacatc
4981 taccccagcccctcaaaagaaaaactgtttacatagaaattcctacacatacgtttgcgt
5041 atatgttattttaaacatctttgtggtgagaatttttccccgatattctccttctgtca
5101 aagtcagaacaaattcagggaatttattttctggcagttgtgctccagtccttttaaaat
5161 tgtacatgaacatgttttagaaacaatatggaggatgatgcatacatgtcggtcaagttc
5221 agcgctcgacattttatggaaagatttttttaaccttaccacgaaatacttaactactgt
5281 ttaagtgaattgacttatttcactttagtttttgaactgtgattattggtatactgttat
5341 atcctcaacttggatttatggtaacccctttttagttcatggagaccaaaatttggggtat
5401 ttataatagtcagcgcaggaatgcacatggaatatctacttgtccttttgaacctcacga
5461 gtcatccagaatgtatagacaggaaaagcatgtcttatttaaaactgtaatttatgggct
5521 caggatctgaccgcagtcccgggagtaagcatttcaaagggggaaggcagtgtggtccct
5581 accctgtgtgaatgtgaggatgtagacatccatcagtgcaactcgagctccatcctcctc
5641 cgatttctaaggctccagttttctggagggacagtcatcatgttttgatttatctgggag
5701 aaaactgtggtgcacagcttgtgaggagggcaaggttgtgacgttcgagcttagttctgg
5761 tgttattctgtctcctcttctttgtcatcagccaaaacgtggtttttaaagagagtcatg
5821 caggttagaaataatgtcaaaaatatttaggaatttaataacctttaagtcagaaactaa
5881 aacaaatactgaaatattagctcttcctacacttcgtgttcccctttagctgcctgaaaa
5941 tcaagattgctcctactcagatcttctgagtggctaaaacttatggatatgaaaaatgag
6001 attgaatgatgactatgctttgctatcattgttacctttcctcaatactatttggcaact
6061 actgggactcttcagcacaaaaggaatagatctatgattgaccctgattttaattgtgaa
6121 attatatgattcatatattttatgaatcagaataaccttcaaataaaataaatctaagtc
6181 ggttaaaatggatttcatgattttccctcagaaaatgagtaacggagtccacggcgtgca
6241 atggtaattataaattggtgatgcttgtttgcaaattgcccactcgtgataagtcaacag
6301 ccaatatttaaaactttgttcgttactggctttaccctaactttctctagtctactgtca
6361 atatcattttaatgtaattgattgtatatagtctcaagaatggttggtgggcatgagttc
6421 ctagagaactgtccaagggttgggaaaatccaaattctcttcctggctccagcactgatt
6481 ttgtacataaacattaggcaggttgcttaacctttttatttcaaactctctcaactctaa
6541 agtgctaataataatctcagttaccttatctttgtcacagggtgttctttttatgaaga
```

Fig. 2B-6

6601 aaaatttgaaaatgataaaagctaagatgccttctaacttcataagcaaacctttaacta 6661 attatgtatctgaaagtcacccccacataccaactcaactttttcctgtgaacacataa 6721 atatattttatagaaaaacaaatctacataaaataaatctactgtttagtgagcagtat 6781 gacttgtacatgccattgaaaattattaatcagaagaaaattaagcagggtctttgctat 6841 acaaaagtgttttccactaattttgcatgcgtatttataagaaaaatgtgaatttggtgg 6901 ttttattctatcggtataaaggcatcgatatttagatgcacccgtgtttgtaaaaatgt 6961 agagcacaatggaattatgctggaagtctcaaataatattttttcctattttatactca 7021 tggaagagataagctaaagaggggacaataatgagaaatgttggtgtgcttttctaagca 7081 tttaaaacataattgccaattgaaaccctaaatatgtttacataccattaagatatgatt 7141 catgtaacaatgttaaattaattataatgggattgggtttgttatctgtggtagtatata 7201 tcctagtgttcctatagtgaaataagtagggttcagccaaagctttctttgttttgtacc 7261 ttaaattgttcgattacgtcatcaaaagagatgaaaggtatgtagaacaggttcacgtga 7321 ttacctttttcttttggcttggattaatattcatagtagaactttataaaacgtgtttgt 7381 attgtaggtggtgtttgtattatgcttatgactatgtatggtttgaaaatattttcatta 7441 tacatgaaattcaactttccaaataaaagttctacttcatgtaatccaaaa

Fig. 2C-1. The cDNA (SEQ ID. NO.: 6) and amino acid sequence (SEQ ID. NO.: 7) of 282P1G3 v.3. The Kozak initiation sequence is shown in bold, and the start methionine is underlined. The open reading frame extends from nucleic acid 272-2953 including the stop codon.

1 cggaccctgcgcgcccccgtcccggctcccggccggctcgggggagaaggcgcccgaggg 61 gaggcgccggacagatcgcgtttcggaggcggcgcaggtgctgtaaactgcaaaccataa 121 tcctgtcttaatactgcaaacaaatcatagtggaactaaggggaacttaatttactgttt 181 ccaggttaactaaggtctcagctgtaaaccaaaagtgagaggagacattaagattttcat

1 M E P L L L G R G L 241 tcttaccgggttgtcttcttcctgaagagcaATGGAGCCGCTTTTACTTGGAAGAGGACT

11 I V Y L M F L L L K F S K A I E I P S S

301 AATCGTATATCTAATGTTCCTCCTGTTAAAATTCTCAAAAGCAATTGAAATACCATCTTC

31 V Q Q V P T I I K Q S K V Q V A F P F D

361 AGTTCAACAGGTTCCAACAATCATAAAACAGTCAAAAGTCCAAGTTGCCTTTCCCTTCGA

51 E Y F Q I E C E A K G N P E P T F S W T

421 TGAGTATTTTCAAATTGAATGTGAAGCTAAAGGAAATCCAGAACCAACATTTTCGTGGAC

71 K D G N P F Y F T D H R I I P S N N S G

481 TAAGGATGGCAACCCTTTTTATTTCACTGACCATCGGATAATTCCATCGAACAATTCAGG

91 T F R I P N E G H I S H F Q G K Y R C F

541 AACATTCAGGATCCCAAACGAGGGGCACATATCTCACTTTCAAGGGAAATACCGCTGCTT

111 A S N K L G I A M S E E I E F I V P S V

601 TGCTTCAAATAAACTGGGAATCGCTATGTCAGAAGAAATAGAATTTATAGTTCCAAGTGT

```
 661 TCCAAAACTCCCAAAAGAAAAAATTGACCCTCTTGAAGTGGAGGAGGGAGATCCAATTGT
 151  L  P  C  N  P  P  K  G  L  P  P  L  H  I  Y  W  M  N  I  E
 721 CCTCCCATGCAATCCTCCCAAAGGCCTCCCACCTTTACACATTTATTGGATGAATATTGA
 171  L  E  H  I  E  Q  D  E  R  V  Y  M  S  Q  K  G  D  L  Y  F
 781 ATTAGAACACATCGAACAAGATGAAAGAGTATACATGAGCCAAAAGGGAGATCTATACTT
 191  A  N  V  E  E  K  D  S  R  N  D  Y  C  C  F  A  A  F  P  R
 841 CGCAAACGTGGAAGAAAAGGACAGTCGCAATGACTACTGTTGCTTTGCTGCATTTCCAAG
 211  L  R  T  I  V  Q  K  M  P  M  K  L  T  V  N  S  L  K  H  A
 901 ATTAAGGACTATTGTACAGAAAATGCCAATGAAACTAACAGTTAACAGTTTAAAGCATGC
 231  N  D  S  S  S  S  T  E  I  G  S  K  A  N  S  I  K  Q  R  K
 961 TAATGACTCAAGTTCATCCACAGAAATTGGTTCCAAGGCAAATTCCATCAAGCAAAGAAA
 251  P  K  L  L  L  P  P  T  E  S  G  S  E  S  S  I  T  I  L  K
1021 ACCCAAACTGCTGTTGCCTCCCACTGAGAGTGGCAGTGAGTCTTCAATTACCATCCTCAA
 271  G  E  I  L  L  L  E  C  F  A  E  G  L  P  T  P  Q  V  D  W
1081 AGGGGAAATCTTGCTGCTTGAGTGTTTTGCTGAAGGCTTGCCAACTCCACAGGTTGATTG
 291  N  K  I  G  G  D  L  P  K  G  R  E  T  K  E  N  Y  G  K  T
1141 GAACAAAATTGGTGGTGACTTACCAAAGGGGAGAGAAACAAAAGAAAATTATGGCAAGAC
 311  L  K  I  E  N  V  S  Y  Q  D  K  G  N  Y  R  C  T  A  S  N
1201 TTTGAAGATAGAGAATGTCTCCTACCAGGACAAAGGAAATTATCGCTGCACAGCCAGCAA
 331  F  L  G  T  A  T  H  D  F  H  V  I  V  E  E  P  P  R  W  T
1261 TTTCTTGGGAACAGCCACTCACGATTTTCACGTTATAGTAGAAGAGCCTCCTCGCTGGAC
 351  K  K  P  Q  S  A  V  Y  S  T  G  S  N  G  I  L  L  C  E  A
1321 AAAGAAGCCTCAGAGTGCTGTGTATAGCACCGGAAGCAATGGCATCTTGTTATGTGAGGC
 371  E  G  E  P  Q  P  T  I  K  W  R  V  N  G  S  P  V  D  N  H
1381 TGAAGGAGAACCTCAACCCACAATCAAGTGGAGAGTCAATGGCTCCCCAGTTGACAATCA
 391  P  F  A  G  D  V  V  F  P  R  E  I  S  F  T  N  L  Q  P  N
1441 TCCATTTGCTGGTGATGTTGTCTTCCCCAGGGAAATCAGTTTTACCAACCTTCAACCAAA
 411  H  T  A  V  Y  Q  C  E  A  S  N  V  H  G  T  I  L  A  N  A
1501 TCATACTGCTGTGTACCAGTGTGAAGCCTCAAATGTCCATGGAACTATCCTTGCCAATGC
 431  N  I  D  V  V  D  V  R  P  L  I  Q  T  K  D  G  E  N  Y  A
1561 CAATATTGATGTTGTGGATGTCCGTCCATTGATACAAACCAAAGATGGAGAAAATTACGC
 451  T  V  V  G  Y  S  A  F  L  H  C  E  F  F  A  S  P  E  A  V
1621 TACAGTGGTTGGGTACAGTGCTTTCTTACATTGCGAGTTCTTTGCTTCACCTGAGGCAGT
 471  V  S  W  Q  K  V  E  E  V  K  P  L  E  G  R  R  Y  H  I  Y
1681 CGTGTCCTGGCAGAAGGTGGAAGAAGTGAAACCCCTGGAGGGCAGGCGGTATCATATCTA
 491  E  N  G  T  L  Q  I  N  R  T  T  E  E  D  A  G  S  Y  S  C
1741 TGAAAATGGCACATTGCAGATCAACAGAACCACCGAAGAAGATGCTGGGTCTTACTCATG
 511  W  V  E  N  A  I  G  K  T  A  V  T  A  N  L  D  I  R  N  A
1801 TTGGGTAGAAAATGCTATAGGAAAAACTGCAGTCACAGCCAATTTGGATATTAGAAATGC
 531  T  K  L  R  V  S  P  K  N  P  R  I  P  K  L  H  M  L  E  L
1861 TACAAAACTTAGAGTTTCTCCTAAGAATCCTCGTATCCCCAAATTGCATATGCTTGAATT
```

Fig. 2C-3

```
551  H  C  E  S  K  C  D  S  H  L  K  H  S  L  K  L  S  W  S  K
1921 ACATTGTGAAAGCAAATGTGACTCACATTTGAAACACAGTTTGAAGTTGTCCTGGAGTAA
571  D  G  E  A  F  E  I  N  G  T  E  D  G  R  I  I  I  D  G  A
1981 AGATGGAGAAGCCTTTGAAATTAATGGCACAGAAGATGGCAGGATAATTATTGATGGAGC
591  N  L  T  I  S  N  V  T  L  E  D  Q  G  I  Y  C  C  S  A  H
2041 TAATTTGACCATATCTAATGTAACTTTAGAGGACCAAGGTATTTACTGCTGTTCAGCTCA
611  T  A  L  D  S  A  A  D  I  T  Q  V  T  V  L  D  V  P  D  P
2101 TACTGCTCTAGACAGTGCTGCCGATATAACTCAAGTAACTGTTCTTGATGTTCCGGATCC
631  P  E  N  L  H  L  S  E  R  Q  N  R  S  V  R  L  T  W  E  A
2161 ACCAGAAAACCTTCACTTGTCTGAAAGACAGAACAGGAGTGTTCGGCTGACCTGGGAAGC
651  G  A  D  H  N  S  N  I  S  E  Y  I  V  E  F  E  G  N  K  E
2221 TGGAGCTGACCACAACAGCAATATTAGCGAGTATATTGTTGAATTTGAAGGAAACAAAGA
671  E  P  G  R  W  E  E  L  T  R  V  Q  G  K  K  T  T  V  I  L
2281 AGAGCCTGGAAGGTGGGAGGAACTGACCAGAGTCCAAGGAAAGAAAACCACAGTTATCTT
691  P  L  A  P  F  V  R  Y  Q  F  R  V  I  A  V  N  E  V  G  R
2341 ACCTTTGGCTCCATTTGTGAGATACCAGTTCAGGGTCATAGCCGTGAACGAAGTAGGGAG
711  S  Q  P  S  Q  P  S  D  H  H  E  T  P  P  A  A  P  D  R  N
2401 AAGTCAGCCTAGCCAGCCGTCAGACCATCATGAAACACCACCAGCAGCTCCAGATAGGAA
731  P  Q  N  I  R  V  Q  A  S  Q  P  K  E  M  I  I  K  W  E  P
2461 TCCACAAAACATAAGGGTTCAAGCCTCTCAACCCAAGGAAATGATTATAAAGTGGGAGCC
751  L  K  S  M  E  Q  N  G  P  G  L  E  Y  R  V  T  W  K  P  Q
2521 TTTGAAATCCATGGAGCAGAATGGACCAGGCCTAGAGTACAGAGTGACCTGGAAGCCACA
771  G  A  P  V  E  W  E  E  E  T  V  T  N  H  T  L  R  V  M  T
2581 GGGAGCCCCAGTGGAGTGGGAAGAAGAAACAGTCACAAACCACACATTGCGGGTGATGAC
791  P  A  V  Y  A  P  Y  D  V  K  V  Q  A  I  N  Q  L  G  S  G
2641 GCCTGCTGTCTATGCCCCTTATGATGTCAAGGTCCAGGCTATCAATCAACTAGGATCTGG
811  P  D  P  Q  S  V  T  L  Y  S  G  E  D  Y  P  D  T  A  P  V
2701 GCCTGACCCTCAGTCAGTGACTCTCTATTCTGGAGAAGACTATCCTGATACAGCTCCAGT
831  I  H  G  V  D  V  I  N  T  T  Y  V  S  N  A  T  G  S  P  Q
2761 GATCCATGGGGTGGACGTTATAAACACAACATATGTAAGCAACGCTACTGGTTCACCCCA
851  P  S  I  F  I  C  S  K  E  Q  E  L  S  Y  R  N  R  N  M  L
2821 ACCTTCCATATTTATCTGTTCAAAGGAGCAAGAACTTTCATATAGGAATAGAAACATGCT
871  A  E  D  F  I  Q  K  S  T  S  C  N  Y  V  E  K  S  S  T  F
2881 GGCCGAAGATTTCATCCAGAAGTCAACATCCTGCAATTATGTTGAAAAGAGTAGTACTTT
891  F  K  I  *
2941 CTTCAAAATATAAatgccaagcacttcaggcctatgttttgcttatattgttttcaggt
3001 gctcaaaatgcaaaacacaaaacaaatcctgcatttagatacacctcaactaaatccaaa
3061 gtccccattcagtatattccatatttgcctgatttactattcggtgtgtttgcatagat
3121 gttgctacttggtgggtttttctccgtatgcacattggtatacagtctctgagaactggc
3181 ttggtgactttgcttcactacaggttaaaagaccataagcaaactggttatttaaaatgt
3241 aaaaaggaatatgaaagtcttattaaaacacttcattgaaaatatacagtctaaatttat
```

Fig. 2C-4

3301 tatttaaattttactagcaaaagtcttaggtgaacaatcaactagtatttgttgagctcc
3361 tatttgcccagagatggtcatatttaaacagaagtatacgtttttcagtttcaacatgaa
3421 tttttttatttctgtcagttatgacatccacgagcatcactttttgtgtctgttttttt
3481 tttttcttggactaaattcaactgcatggaagcggtggtcagaaggttgttttatacgag
3541 aacaggcagaaagtgcccattgttcaggattctaatagctacatctacttaatatcttca
3601 tttctaaattgactgcttttaccttttttctcatgtttatataatggtatgcttgcatata
3661 tttcatgaatacattgtacatattatgttaatatttacacaatttaaaatatagatgtgt
3721 tttattttgaagtgagaaaatgaacattaacaggcatgtttgtacagctagaatatatta
3781 gtaagatactgtttttcgtcattccagagctacaactaataacacgaggttccaaagctg
3841 aagactttgtataaagtatttgggttttgttcttgtattgctttctttcaacagtttcaa
3901 aataaaatatcatacaaatattgagggaaatgttttcatatttttcaaaataggtttttta
3961 ttgttgaatgtacatctaccccagcccctcaaaagaaaaactgtttacatagaaattcct
4021 acacatacgtttgcgtatatgttattttaaacatctttgtggtgagaatttttttccccga
4081 tattctccttctgtcaaagtcagaacaaattcagggaatttattttctggcagttgtgct
4141 ccagtccttttaaaattgtacatgaacatgttttagaaacaatatggaggatgatgcata
4201 catgtcggtcaagttcagcgctcgacattttatggaaagattttttaaccttaccacga
4261 aatacttaactactgtttaagtgaattgacttatttcactttagtttttgaactgtgatt
4321 attggtatactgttatatcctcaacttggatttatggtaacccccttttagttcatggaga
4381 ccaaaatttggggtatttataatagtcagcgcaggaatgcacatggaatatctacttgtc
4441 cttttgaacctcacgagtcatccagaatgtatagacaggaaaagcatgtcttatttaaaa
4501 ctgtaatttatgggctcaggatctgaccgcagtcccgggagtaagcatttcaaaggggga
4561 aggcagtgtggtccctaccctgtgtgaatgtgaggatgtagacatccatcagtgcaactc
4621 gagctccatcctcctccgatttctaaggctccagttttctggagggacagtcatcatgtt
4681 ttgatttatctgggagaaaactgtggtgcacagcttgtgaggagggcaaggttgtgacgt
4741 tcgagcttagttctggtgttattctgtctcctcttctttgtcatcagccaaaacgtggtt
4801 tttaaagagagtcatgcaggttagaaataatgtcaaaaatatttaggaatttaataacct
4861 ttaagtcagaaactaaaacaaatactgaaatattagctcttcctacacttcgtgttcccc
4921 tttagctgcctgaaaatcaagattgctcctactcagatcttctgagtggctaaaacttat
4981 ggatatgaaaaatgagattgaatgatgactatgctttgctatcattgttacctttcctca
5041 atactatttggcaactactgggactcttcagcacaaaaggaatagatctatgattgaccc
5101 tgattttaattgtgaaattatatgattcatatattttatgaatcagaataaccttcaaat
5161 aaaataaatctaagtcggttaaaatggatttcatgattttccctcagaaaatgagtaacg
5221 gagtccacggcgtgcaatggtaattataaattggtgatgcttgtttgcaaattgcccact
5281 cgtgataagtcaacagccaatatttaaaactttgttcgttactggctttaccctaacttt
5341 ctctagtctactgtcaatatcattttaatgtaattgattgtatatagtctcaagaatggt
5401 tggtgggcatgagttcctagagaactgtccaagggttgggaaaatccaaattctcttcct
5461 ggctccagcactgattttgtacataaacattaggcaggttgcttaaccttttttatttcaa
5521 actctctcaactctaaagtgctaataataatctcagttaccttatctttgtcacagggtg
5581 ttcttttttatgaagaaaaatttgaaaatgataaaagctaagatgccttctaacttcata
5641 agcaaacctttaactaattatgtatctgaaagtcacccccacataccaactcaactttttt
5701 tcctgtgaacacataaatatatttttatagaaaaacaaatctacataaaataaatctact

Fig. 2C-5

```
5761 gtttagtgagcagtatgacttgtacatgccattgaaaattattaatcagaagaaaattaa
5821 gcagggtctttgctatacaaaagtgttttccactaattttgcatgcgtatttataagaaa
5881 aatgtgaatttggtggttttattctatcggtataaaggcatcgatattttagatgcaccc
5941 gtgtttgtaaaaatgtagagcacaatggaattatgctggaagtctcaaataatatttttt
6001 tcctattttatactcatggaagagataagctaaagaggggacaataatgagaaatgttgg
6061 tgtgcttttctaagcatttaaaacataattgccaattgaaaccctaaatatgtttacata
6121 ccattaagatatgattcatgtaacaatgttaaattaattataatgggattgggtttgtta
6181 tctgtggtagtatatatcctagtgttcctatagtgaaataagtagggttcagccaaagct
6241 ttctttgttttgtaccttaaattgttcgattacgtcatcaaaagagatgaaaggtatgta
6301 gaacaggttcacgtgattacctttttcttttggcttggattaatattcatagtagaactt
6361 tataaaacgtgtttgtattgtaggtggtgtttgtattatgcttatgactatgtatggttt
6421 gaaaatattttcattatacatgaaattcaactttccaaataaaagttctacttcatgtaa
6481 tccaaaa
```

Fig. 2D-1. The cDNA (SEQ ID. NO.: 8) and amino acid sequence (SEQ ID. NO.: 9) of 282P1G3 v.4. The Kozak initiation sequence is shown in bold, and the start methionine is underlined. The open reading frame extends from nucleic acid 272-3625 including the stop codon.

```
  1 cggaccctgcgcgccccccgtcccggctcccggccggctcgggggagaaggcgcccgaggg
 61 gaggcgccggacagatcgcgtttcggaggcggcgcaggtgctgtaaactgcaaaccataa
121 tcctgtcttaatactgcaaacaaatcatagtggaactaaggggaacttaatttactgttt
181 ccaggttaactaaggtctcagctgtaaaccaaaagtgagaggagacattaagattttcat
  1                                M  E  P  L  L  L  G  R  G  L
241 tcttaccgggttgtcttcttcctgaagagcaATGGAGCCGCTTTTACTTGGAAGAGGACT
 11  I  V  Y  L  M  F  L  L  L  K  F  S  K  A  I  E  I  P  S  S
301 AATCGTATATCTAATGTTCCTCCTGTTAAAATTCTCAAAAGCAATTGAAATACCATCTTC
 31  V  Q  Q  V  P  T  I  I  K  Q  S  K  V  Q  V  A  F  P  F  D
361 AGTTCAACAGGTTCCAACAATCATAAAACAGTCAAAAGTCCAAGTTGCCTTTCCCTTCGA
 51  E  Y  F  Q  I  E  C  E  A  K  G  N  P  E  P  T  F  S  W  T
421 TGAGTATTTTCAAATTGAATGTGAAGCTAAAGGAAATCCAGAACCAACATTTTCGTGGAC
 71  K  D  G  N  P  F  Y  F  T  D  H  R  I  I  P  S  N  N  S  G
481 TAAGGATGGCAACCCTTTTTATTTCACTGACCATCGGATAATTCCATCGAACAATTCAGG
 91  T  F  R  I  P  N  E  G  H  I  S  H  F  Q  G  K  Y  R  C  F
541 AACATTCAGGATCCCAAACGAGGGGCACATATCTCACTTTCAAGGGAAATACCGCTGCTT
111  A  S  N  K  L  G  I  A  M  S  E  E  I  E  F  I  V  P  S  V
601 TGCTTCAAATAAACTGGGAATCGCTATGTCAGAAGAAATAGAATTTATAGTTCCAAGTGT
131  P  K  L  P  K  E  K  I  D  P  L  E  V  E  E  G  D  P  I  V
661 TCCAAAACTCCCAAAAGAAAAAATTGACCCTCTTGAAGTGGAGGAGGGAGATCCAATTGT
151  L  P  C  N  P  P  K  G  L  P  P  L  H  I  Y  W  M  N  I  E
721 CCTCCCATGCAATCCTCCCAAAGGCCTCCCACCTTTACACATTTATTGGATGAATATTGA
171  L  E  H  I  E  Q  D  E  R  V  Y  M  S  Q  K  G  D  L  Y  F
```

Fig. 2D-2

781 ATTAGAACACATCGAACAAGATGAAAGAGTATACATGAGCCAAAAGGGAGATCTATACTT
191 A N V E E K D S R N D Y C C F A A F P R
841 CGCAAACGTGGAAGAAAAGGACAGTCGCAATGACTACTGTTGCTTTGCTGCATTTCCAAG
211 L R T I V Q K M P M K L T V N S L K H A
901 ATTAAGGACTATTGTACAGAAAATGCCAATGAAACTAACAGTTAACAGTTTAAAGCATGC
231 N D S S S S T E I G S K A N S I K Q R K
961 TAATGACTCAAGTTCATCCACAGAAATTGGTTCCAAGGCAAATTCCATCAAGCAAAGAAA
251 P K L L L P P T E S G S E S S I T I L K
1021 ACCCAAACTGCTGTTGCCTCCCACTGAGAGTGGCAGTGAGTCTTCAATTACCATCCTCAA
271 G E I L L L E C F A E G L P T P Q V D W
1081 AGGGGAAATCTTGCTGCTTGAGTGTTTTGCTGAAGGCTTGCCAACTCCACAGGTTGATTG
291 N K I G G D L P K G R E T K E N Y G K T
1141 GAACAAAATTGGTGGTGACTTACCAAAGGGGAGAGAAACAAAAGAAAATTATGGCAAGAC
311 L K I E N V S Y Q D K G N Y R C T A S N
1201 TTTGAAGATAGAGAATGTCTCCTACCAGGACAAAGGAAATTATCGCTGCACAGCCAGCAA
331 F L G T A T H D F H V I V E E P P R W T
1261 TTTCTTGGGAACAGCCACTCACGATTTTCACGTTATAGTAGAAGAGCCTCCTCGCTGGAC
351 K K P Q S A V Y S T G S N G I L L C E A
1321 AAAGAAGCCTCAGAGTGCTGTGTATAGCACCGGAAGCAATGGCATCTTGTTATGTGAGGC
371 E G E P Q P T I K W R V N G S P V D N H
1381 TGAAGGAGAACCTCAACCCACAATCAAGTGGAGAGTCAATGGCTCCCCAGTTGACAATCA
391 P F A G D V V F P R E I S F T N L Q P N
1441 TCCATTTGCTGGTGATGTTGTCTTCCCCAGGGAAATCAGTTTTACCAACCTTCAACCAAA
411 H T A V Y Q C E A S N V H G T I L A N A
1501 TCATACTGCTGTGTACCAGTGTGAAGCCTCAAATGTCCATGGAACTATCCTTGCCAATGC
431 N I D V V D V R P L I Q T K D G E N Y A
1561 CAATATTGATGTTGTGGATGTCCGTCCATTGATACAAACCAAAGATGGAGAAAATTACGC
451 T V V G Y S A F L H C E F F A S P E A V
1621 TACAGTGGTTGGGTACAGTGCTTTCTTACATTGCGAGTTCTTTGCTTCACCTGAGGCAGT
471 V S W Q K V E E V K P L E G R R Y H I Y
1681 CGTGTCCTGGCAGAAGGTGGAAGAAGTGAAACCCCTGGAGGGCAGGCGGTATCATATCTA
491 E N G T L Q I N R T T E E D A G S Y S C
1741 TGAAAATGGCACATTGCAGATCAACAGAACCACCGAAGAAGATGCTGGGTCTTACTCATG
511 W V E N A I G K T A V T A N L D I R N A
1801 TTGGGTAGAAAATGCTATAGGAAAAACTGCAGTCACAGCCAATTTGGATATTAGAAATGC
531 T K L R V S P K N P R I P K L H M L E L
1861 TACAAAACTTAGAGTTTCTCCTAAGAATCCTCGTATCCCCAAATTGCATATGCTTGAATT
551 H C E S K C D S H L K H S L K L S W S K
1921 ACATTGTGAAAGCAAATGTGACTCACATTTGAAACACAGTTTGAAGTTGTCCTGGAGTAA
571 D G E A F E I N G T E D G R I I I D G A
1981 AGATGGAGAAGCCTTTGAAATTAATGGCACAGAAGATGGCAGGATAATTATTGATGGAGC

Fig. 2D-3

```
 591 N  L  T  I  S  N  V  T  L  E  D  Q  G  I  Y  C  C  S  A  H
2041 TAATTTGACCATATCTAATGTAACTTTAGAGGACCAAGGTATTTACTGCTGTTCAGCTCA
 611 T  A  L  D  S  A  A  D  I  T  Q  V  T  V  L  D  V  P  D  P
2101 TACTGCTCTAGACAGTGCTGCCGATATAACTCAAGTAACTGTTCTTGATGTTCCGGATCC
 631 P  E  N  L  H  L  S  E  R  Q  N  R  S  V  R  L  T  W  E  A
2161 ACCAGAAAACCTTCACTTGTCTGAAAGACAGAACAGGAGTGTTCGGCTGACCTGGGAAGC
 651 G  A  D  H  N  S  N  I  S  E  Y  I  V  E  F  E  G  N  K  E
2221 TGGAGCTGACCACAACAGCAATATTAGCGAGTATATTGTTGAATTTGAAGGAAACAAAGA
 671 E  P  G  R  W  E  E  L  T  R  V  Q  G  K  K  T  T  V  I  L
2281 AGAGCCTGGAAGGTGGGAGGAACTGACCAGAGTCCAAGGAAAGAAAACCACAGTTATCTT
 691 P  L  A  P  F  V  R  Y  Q  F  R  V  I  A  V  N  E  V  G  R
2341 ACCTTTGGCTCCATTTGTGAGATACCAGTTCAGGGTCATAGCCGTGAACGAAGTAGGGAG
 711 S  Q  P  S  Q  P  S  D  H  H  E  T  P  P  A  A  P  D  R  N
2401 AAGTCAGCCTAGCCAGCCGTCAGACCATCATGAAACACCACCAGCAGCTCCAGATAGGAA
 731 P  Q  N  I  R  V  Q  A  S  Q  P  K  E  M  I  I  K  W  E  P
2461 TCCACAAAACATAAGGGTTCAAGCCTCTCAACCCAAGGAAATGATTATAAAGTGGGAGCC
 751 L  K  S  M  E  Q  N  G  P  G  L  E  Y  R  V  T  W  K  P  Q
2521 TTTGAAATCCATGGAGCAGAATGGACCAGGCCTAGAGTACAGAGTGACCTGGAAGCCACA
 771 G  A  P  V  E  W  E  E  E  T  V  T  N  H  T  L  R  V  M  T
2581 GGGAGCCCCAGTGGAGTGGGAAGAAGAAACAGTCACAAACCACACATTGCGGGTGATGAC
 791 P  A  V  Y  A  P  Y  D  V  K  V  Q  A  I  N  Q  L  G  S  G
2641 GCCTGCTGTCTATGCCCCTTATGATGTCAAGGTCCAGGCTATCAATCAACTAGGATCTGG
 811 P  D  P  Q  S  V  T  L  Y  S  G  E  D  L  P  E  Q  P  T  F
2701 GCCTGACCCTCAGTCAGTGACTCTCTATTCTGGAGAAGACTTACCTGAACAGCCAACTTT
 831 L  K  V  I  K  V  D  K  D  T  A  T  L  S  W  G  L  P  K  K
2761 TCTAAAGGTCATCAAAGTTGATAAAGACACTGCCACTTTATCTTGGGGACTACCTAAGAA
 851 L  N  G  N  L  T  G  Y  L  L  Q  Y  Q  I  I  N  D  T  Y  E
2821 ATTAAATGGAAACTTAACTGGCTATCTTTTGCAATATCAGATAATAAATGACACCTACGA
 871 I  G  E  L  N  D  I  N  I  T  T  P  S  K  P  S  W  H  L  S
2881 GATTGGAGAATTAAATGATATTAACATTACAACTCCATCAAAGCCCAGCTGGCACCTCTC
 891 N  L  N  A  T  T  K  Y  K  F  Y  L  R  A  C  T  S  Q  G  C
2941 AAACCTGAATGCAACTACCAAGTACAAATTCTACTTGAGGGCTTGCACTTCACAGGGCTG
 911 G  K  P  I  T  E  E  S  S  T  L  G  E  G  S  K  G  I  G  K
3001 TGGAAAACCGATCACGGAGGAAAGCTCCACCTTAGGAGAAGGGAGTAAAGGTATCGGGAA
 931 I  S  G  V  N  L  T  Q  K  T  H  P  I  E  V  F  E  P  G  A
3061 GATATCAGGAGTAAATCTTACTCAAAAGACTCACCCAATAGAGGTATTTGAGCCGGGAGC
 951 E  H  I  V  R  L  M  T  K  N  W  G  D  N  D  S  I  F  Q  D
3121 TGAACATATAGTTCGCCTAATGACTAAGAATTGGGGCGATAACGATAGCATTTTTCAAGA
 971 V  I  E  T  R  G  R  E  Y  A  G  L  Y  D  D  I  S  T  Q  G
3181 TGTAATTGAGACAAGAGGGAGAGAATATGCTGGTTTATATGATGACATCTCCACTCAAGG
 991 W  F  I  G  L  M  C  A  I  A  L  L  T  L  L  L  L  T  V  C
```

Fig. 2D-4

3241 CTGGTTTATTGGACTGATGTGTGCGATTGCTCTTCTCACACTACTATTATTAACTGTTTG
1011 F V K R N R G G K Y S V K E K E D L H P
3301 CTTTGTGAAGAGGAATAGAGGTGGAAAGTACTCAGTTAAAGAAAAGGAAGATTTGCATCC
1031 D P E I Q S V K D E T F G E Y S D S D E
3361 AGACCCAGAAATTCAGTCAGTAAAAGATGAAACCTTTGGTGAATACAGTGACAGTGATGA
1051 K P L K G S L R S L N R D M Q P T E S A
3421 AAAGCCTCTCAAAGGAAGCCTTCGGTCCCTTAATAGGGATATGCAGCCTACTGAAAGTGC
1071 D S L V E Y G E G D H G L F S E D G S F
3481 TGACAGCTTAGTCGAATACGGAGAGGGAGACCATGGTCTCTTCAGTGAAGATGGATCATT
1091 I G A Y A G S K E K G S V E S N G S S T
3541 TATTGGTGCCTACGCTGGATCTAAGGAGAAGGGATCTGTTGAAAGCAATGGAAGTTCTAC
1111 A T F P L R A *
3601 AGCAACTTTTCCCCTTCGGGCATAAacacaacatatgtaagcaacgctactggttcaccc
3661 caaccttccatatttatctgttcaaaggagcaagaactttcatataggaatagaaacatg
3721 ctggccgaagatttcatccagaagtcaacatcctgcaattatgttgaaaagagtagtact
3781 ttcttcaaaatataaaatgccaagcacttcaggcctatgttttgcttatattgttttcag
3841 gtgctcaaaatgcaaaacacaaaacaaatcctgcatttagatacacctcaactaaatcca
3901 aagtccccattcagtatattccatatttgcctgattttactattcggtgtgtttgcatag
3961 atgttgctacttggtgggtttttctccgtatgcacattggtatacagtctctgagaactg
4021 gcttggtgactttgcttcactacaggttaaaagaccataagcaaactggttatttaaaat
4081 gtaaaaaggaatatgaaagtcttattaaaacacttcattgaaaatatacagtctaaattt
4141 attatttaaattttactagcaaaagtcttaggtgaacaatcaactagtatttgttgagct
4201 cctatttgcccagagatggtcatatttaaacagaagtatacgtttttcagtttcaacatg
4261 aatttttttatttctgtcagttatgacatccacgagcatcacttttgtgtctgtttttt
4321 tttttttcttggactaaattcaactgcatggaagcggtggtcagaaggttgttttatacg
4381 agaacaggcagaaagtgcccattgttcaggattctaatagctacatctacttaatatctt
4441 catttctaaattgactgcttttaccttttctcatgtttatataatggtatgcttgcata
4501 tatttcatgaatacattgtacatattatgttaatatttacacaatttaaaatatagatgt
4561 gtttatttgaagtgagaaaatgaacattaacaggcatgtttgtacagctagaatatat
4621 tagtaagatactgtttttcgtcattccagagctacaactaataacacgaggttccaaagc
4681 tgaagactttgtataaagtatttgggttttgttcttgtattgctttctttcaacagtttc
4741 aaaataaaatatcatacaaatattgagggaaatgttttcatatttttcaaaataggtttt
4801 tattgttgaatgtacatctaccccagcccctcaaaagaaaaactgtttacatagaaattc
4861 ctacacatacgtttgcgtatatgttattttaaacatctttgtggtgagaatttttcccc
4921 gatattctccttctgtcaaagtcagaacaaattcagggaatttattttctggcagttgtg
4981 ctccagtccttttaaaattgtacatgaacatgttttagaaacaatatggaggatgatgca
5041 tacatgtcggtcaagttcagcgctcgacattttatggaaagattttttaaccttaccac
5101 gaaatacttaactactgtttaagtgaattgacttatttcactttagtttttgaactgtga
5161 ttattggtatactgttatatcctcaacttggatttatggtaacccctttagttcatgga
5221 gaccaaaatttggggtatttataatagtcagcgcaggaatgcacatggaatatctacttg
5281 tccttttgaacctcacgagtcatccagaatgtatagacaggaaaagcatgtcttatttaa

Fig. 2D-5

5341 aactgtaatttatgggctcaggatctgaccgcagtcccgggagtaagcatttcaaagggg
5401 gaaggcagtgtggtccctaccctgtgtgaatgtgaggatgtagacatccatcagtgcaac
5461 tcgagctccatcctcctccgatttctaaggctccagttttctggagggacagtcatcatg
5521 ttttgatttatctgggagaaaactgtggtgcacagcttgtgaggagggcaaggttgtgac
5581 gttcgagcttagttctggtgttattctgtctcctcttctttgtcatcagccaaaacgtgg
5641 tttttaaagagagtcatgcaggttagaaataatgtcaaaaatatttaggaatttaataac
5701 ctttaagtcagaaactaaaacaaatactgaaatattagctcttcctacacttcgtgttcc
5761 cctttagctgcctgaaaatcaagattgctcctactcagatcttctgagtggctaaaactt
5821 atggatatgaaaaatgagattgaatgatgactatgctttgctatcattgttacctttcct
5881 caatactatttggcaactactgggactcttcagcacaaaaggaatagatctatgattgac
5941 cctgattttaattgtgaaattatatgattcatatattttatgaatcagaataaccttcaa
6001 ataaaataaatctaagtcggttaaaatggatttcatgattttccctcagaaaatgagtaa
6061 cggagtccacggcgtgcaatggtaattataaattggtgatgcttgtttgcaaattgccca
6121 ctcgtgataagtcaacagccaatatttaaaactttgttcgttactggctttaccctaact
6181 ttctctagtctactgtcaatatcattttaatgtaattgattgtatatagtctcaagaatg
6241 gttggtgggcatgagttcctagagaactgtccaagggttgggaaaatccaaattctcttc
6301 ctggctccagcactgattttgtacataaacattaggcaggttgcttaaccttttttatttc
6361 aaactctctcaactctaaagtgctaataataatctcagttaccttatctttgtcacaggg
6421 tgttctttttttatgaagaaaaatttgaaaatgataaaagctaagatgccttctaacttca
6481 taagcaaacctttaactaattatgtatctgaaagtcacccccacataccaactcaacttt
6541 tttcctgtgaacacataaatatatttttatagaaaaacaaatctacataaaataaatcta
6601 ctgtttagtgagcagtatgacttgtacatgccattgaaaattattaatcagaagaaaatt
6661 aagcagggtctttgctatacaaaagtgttttccactaattttgcatgcgtatttataaga
6721 aaaatgtgaatttggtggttttattctatcggtataaaggcatcgatatttagatgcac
6781 ccgtgtttgtaaaaatgtagagcacaatggaattatgctggaagtctcaaataatatttt
6841 tttcctattttatactcatggaagagataagctaaagaggggacaataatgagaaatgtt
6901 ggtgtgcttttctaagcatttaaaacataattgccaattgaaaccctaaatatgtttaca
6961 taccattaagatatgattcatgtaacaatgttaaattaattataatgggattgggtttgt
7021 tatctgtggtagtatatatcctagtgttcctatagtgaaataagtagggttcagccaaag
7081 ctttctttgttttgtaccttaaattgttcgattacgtcatcaaaagagatgaaaggtatg
7141 tagaacaggttcacgtgattacctttttcttttggcttggattaatattcatagtagaac
7201 tttataaaacgtgtttgtattgtaggtggtgtttgtattatgcttatgactatgtatggt
7261 ttgaaaatattttcattatacatgaaattcaactttccaaataaaagttctacttcatgt
7321 aatccaaaa

Fig. 2E-1. The cDNA (SEQ ID. NO.: 10) and amino acid sequence (SEQ ID. NO.: 11) of 282P1G3 v.5. The Kozak initiation sequence is shown in bold, and the start methionine is underlined. The open reading frame extends from nucleic acid 272-3898 including the stop codon.

1 cggaccctgcgcgcccccgtcccggctcccggccggctcgggggagaaggcgcccgaggg 61 gaggcgccggacagatcgcgtttcggaggcggcgcaggtgctgtaaactgcaaaccataa 121 tcctgtcttaatactgcaaacaaatcatagtggaactaaggggaacttaatttactgttt 181 ccaggttaactaaggtctcagctgtaaaccaaaagtgagaggagacattaagattttcat

1 M E P L L L G R G L 241 tcttaccgggttgtcttcttcctgaagagcaATGGAGCCGCTTTTACTTGGAAGAGGACT

11 I V Y L M F L L L K F S K A I E I P S S

301 AATCGTATATCTAATGTTCCTCCTGTTAAAATTCTCAAAAGCAATTGAAATACCATCTTC

31 V Q Q V P T I I K Q S K V Q V A F P F D

361 AGTTCAACAGGTTCCAACAATCATAAAACAGTCAAAAGTCCAAGTTGCCTTTCCCTTCGA

51 E Y F Q I E C E A K G N P E P T F S W T

421 TGAGTATTTTCAAATTGAATGTGAAGCTAAAGGAAATCCAGAACCAACATTTTCGTGGAC

71 K D G N P F Y F T D H R I I P S N N S G

481 TAAGGATGGCAACCCTTTTTATTTCACTGACCATCGGATAATTCCATCGAACAATTCAGG

91 T F R I P N E G H I S H F Q G K Y R C F

541 AACATTCAGGATCCCAAACGAGGGGCACATATCTCACTTTCAAGGGAAATACCGCTGCTT

111 A S N K L G I A M S E E I E F I V P S V

601 TGCTTCAAATAAACTGGGAATCGCTATGTCAGAAGAAATAGAATTTATAGTTCCAAGTGT

131 P K L P K E K I D P L E V E E G D P I V

661 TCCAAAACTCCCAAAAGAAAAAATTGACCCTCTTGAAGTGGAGGAGGGAGATCCAATTGT

151 L P C N P P K G L P P L H I Y W M N I E

721 CCTCCCATGCAATCCTCCCAAAGGCCTCCCACCTTTACACATTTATTGGATGAATATTGA

171 L E H I E Q D E R V Y M S Q K G D L Y F

781 ATTAGAACACATCGAACAAGATGAAAGAGTATACATGAGCCAAAAGGGAGATCTATACTT

191 A N V E E K D S R N D Y C C F A A F P R

841 CGCAAACGTGGAAGAAAAGGACAGTCGCAATGACTACTGTTGCTTTGCTGCATTTCCAAG

211 L R T I V Q K M P M K L T V N S S N S I

901 ATTAAGGACTATTGTACAGAAAATGCCAATGAAACTAACAGTTAACAGTTCAAATTCCAT

231 K Q R K P K L L L P P T E S G S E S S I

961 CAAGCAAAGAAAACCCAAACTGCTGTTGCCTCCCACTGAGAGTGGCAGTGAGTCTTCAAT

251 T I L K G E I L L L E C F A E G L P T P

1021 TACCATCCTCAAAGGGGAAATCTTGCTGCTTGAGTGTTTTGCTGAAGGCTTGCCAACTCC

271 Q V D W N K I G G D L P K G R E T K E N

1081 ACAGGTTGATTGGAACAAAATTGGTGGTGACTTACCAAAGGGGAGAGAAACAAAAGAAAA

291 Y G K T L K I E N V S Y Q D K G N Y R C

1141 TTATGGCAAGACTTTGAAGATAGAGAATGTCTCCTACCAGGACAAAGGAAATTATCGCTG

```
1201 CACAGCCAGCAATTTCTTGGGAACAGCCACTCACGATTTTCACGTTATAGTAGAAGAGCC
 331   P   R   W   T   K   K   P   Q   S   A   V   Y   S   T   G   S   N   G   I   L
1261 TCCTCGCTGGACAAAGAAGCCTCAGAGTGCTGTGTATAGCACCGGAAGCAATGGCATCTT
 351   L   C   E   A   E   G   E   P   Q   P   T   I   K   W   R   V   N   G   S   P
1321 GTTATGTGAGGCTGAAGGAGAACCTCAACCCACAATCAAGTGGAGAGTCAATGGCTCCCC
 371   V   D   N   H   P   F   A   G   D   V   V   F   P   R   E   I   S   F   T   N
1381 AGTTGACAATCATCCATTTGCTGGTGATGTTGTCTTCCCCAGGGAAATCAGTTTTACCAA
 391   L   Q   P   N   H   T   A   V   Y   Q   C   E   A   S   N   V   H   G   T   I
1441 CCTTCAACCAAATCATACTGCTGTGTACCAGTGTGAAGCCTCAAATGTCCATGGAACTAT
 411   L   A   N   A   N   I   D   V   V   D   V   R   P   L   I   Q   T   K   D   G
1501 CCTTGCCAATGCCAATATTGATGTTGTGGATGTCCGTCCATTGATACAAACCAAAGATGG
 431   E   N   Y   A   T   V   V   G   Y   S   A   F   L   H   C   E   F   F   A   S
1561 AGAAAATTACGCTACAGTGGTTGGGTACAGTGCTTTCTTACATTGCGAGTTCTTTGCTTC
 451   P   E   A   V   V   S   W   Q   K   V   E   E   V   K   P   L   E   G   R   R
1621 ACCTGAGGCAGTCGTGTCCTGGCAGAAGGTGGAAGAAGTGAAACCCCTGGAGGGCAGGCG
 471   Y   H   I   Y   E   N   G   T   L   Q   I   N   R   T   T   E   E   D   A   G
1681 GTATCATATCTATGAAAATGGCACATTGCAGATCAACAGAACCACCGAAGAAGATGCTGG
 491   S   Y   S   C   W   V   E   N   A   I   G   K   T   A   V   T   A   N   L   D
1741 GTCTTACTCATGTTGGGTAGAAAATGCTATAGGAAAAACTGCAGTCACAGCCAATTTGGA
 511   I   R   N   A   T   K   L   R   V   S   P   K   N   P   R   I   P   K   L   H
1801 TATTAGAAATGCTACAAAACTTAGAGTTTCTCCTAAGAATCCTCGTATCCCCAAATTGCA
 531   M   L   E   L   H   C   E   S   K   C   D   S   H   L   K   H   S   L   K   L
1861 TATGCTTGAATTACATTGTGAAAGCAAATGTGACTCACATTTGAAACACAGTTTGAAGTT
 551   S   W   S   K   D   G   E   A   F   E   I   N   G   T   E   D   G   R   I   I
1921 GTCCTGGAGTAAAGATGGAGAAGCCTTTGAAATTAATGGCACAGAAGATGGCAGGATAAT
 571   I   D   G   A   N   L   T   I   S   N   V   T   L   E   D   Q   G   I   Y   C
1981 TATTGATGGAGCTAATTTGACCATATCTAATGTAACTTTAGAGGACCAAGGTATTTACTG
 591   C   S   A   H   T   A   L   D   S   A   A   D   I   T   Q   V   T   V   L   D
2041 CTGTTCAGCTCATACTGCTCTAGACAGTGCTGCCGATATAACTCAAGTAACTGTTCTTGA
 611   V   P   D   P   P   E   N   L   H   L   S   E   R   Q   N   R   S   V   R   L
2101 TGTTCCGGATCCACCAGAAAACCTTCACTTGTCTGAAAGACAGAACAGGAGTGTTCGGCT
 631   T   W   E   A   G   A   D   H   N   S   N   I   S   E   Y   I   V   E   F   E
2161 GACCTGGGAAGCTGGAGCTGACCACAACAGCAATATTAGCGAGTATATTGTTGAATTTGA
 651   G   N   K   E   E   P   G   R   W   E   E   L   T   R   V   Q   G   K   K   T
2221 AGGAAACAAAGAAGAGCCTGGAAGGTGGGAGGAACTGACCAGAGTCCAAGGAAAGAAAAC
 671   T   V   I   L   P   L   A   P   F   V   R   Y   Q   F   R   V   I   A   V   N
2281 CACAGTTATCTTACCTTTGGCTCCATTTGTGAGATACCAGTTCAGGGTCATAGCCGTGAA
 691   E   V   G   R   S   Q   P   S   Q   P   S   D   H   H   E   T   P   P   A   A
2341 CGAAGTAGGGAGAAGTCAGCCTAGCCAGCCGTCAGACCATCATGAAACACCACCAGCAGC
 711   P   D   R   N   P   Q   N   I   R   V   Q   A   S   Q   P   K   E   M   I   I
2401 TCCAGATAGGAATCCACAAAACATAAGGGTTCAAGCCTCTCAACCCAAGGAAATGATTAT
```

Fig. 2E-3

```
731  K  W  E  P  L  K  S  M  E  Q  N  G  P  G  L  E  Y  R  V  T
2461 AAAGTGGGAGCCTTTGAAATCCATGGAGCAGAATGGACCAGGCCTAGAGTACAGAGTGAC
751  W  K  P  Q  G  A  P  V  E  W  E  E  E  T  V  T  N  H  T  L
2521 CTGGAAGCCACAGGGAGCCCCAGTGGAGTGGGAAGAAGAAACAGTCACAAACCACACATT
771  R  V  M  T  P  A  V  Y  A  P  Y  D  V  K  V  Q  A  I  N  Q
2581 GCGGGTGATGACGCCTGCTGTCTATGCCCCTTATGATGTCAAGGTCCAGGCTATCAATCA
791  L  G  S  G  P  D  P  Q  S  V  T  L  Y  S  G  E  D  Y  P  D
2641 ACTAGGATCTGGGCCTGACCCTCAGTCAGTGACTCTCTATTCTGGAGAAGACTATCCTGA
811  T  A  P  V  I  H  G  V  D  V  I  N  S  T  L  V  K  V  T  W
2701 TACAGCTCCAGTGATCCATGGGGTGGACGTTATAAACAGTACATTAGTTAAAGTTACCTG
831  S  T  V  P  K  D  R  V  H  G  R  L  K  G  Y  Q  I  N  W  W
2761 GTCAACAGTTCCAAAGGACAGAGTACATGGACGTCTGAAAGGCTATCAGATAAATTGGTG
851  K  T  K  S  L  L  D  G  R  T  H  P  K  E  V  N  I  L  R  F
2821 GAAAACAAAAAGTCTGTTGGATGGAAGAACACATCCCAAAGAAGTGAACATTCTAAGATT
871  S  G  Q  R  N  S  G  M  V  P  S  L  D  A  F  S  E  F  H  L
2881 TTCAGGACAAAGAAACTCTGGAATGGTTCCTTCCTTAGATGCCTTTAGTGAATTTCATTT
891  T  V  L  A  Y  N  S  K  G  A  G  P  E  S  E  P  Y  I  F  Q
2941 AACAGTCTTAGCCTATAACTCTAAAGGAGCTGGTCCTGAAAGTGAGCCTTATATATTTCA
911  T  P  E  G  V  P  E  Q  P  T  F  L  K  V  I  K  V  D  K  D
3001 AACACCAGAAGGAGTACCTGAACAGCCAACTTTTCTAAAGGTCATCAAAGTTGATAAAGA
931  T  A  T  L  S  W  G  L  P  K  K  L  N  G  N  L  T  G  Y  L
3061 CACTGCCACTTTATCTTGGGGACTACCTAAGAAATTAAATGGAAACTTAACTGGCTATCT
951  L  Q  Y  Q  I  I  N  D  T  Y  E  I  G  E  L  N  D  I  N  I
3121 TTTGCAATATCAGATAATAAATGACACCTACGAGATTGGAGAATTAAATGATATTAACAT
971  T  T  P  S  K  P  S  W  H  L  S  N  L  N  A  T  T  K  Y  K
3181 TACAACTCCATCAAAGCCCAGCTGGCACCTCTCAAACCTGAATGCAACTACCAAGTACAA
991  F  Y  L  R  A  C  T  S  Q  G  C  G  K  P  I  T  E  E  S  S
3241 ATTCTACTTGAGGGCTTGCACTTCACAGGGCTGTGGAAAACCGATCACGGAGGAAAGCTC
1011 T  L  G  E  G  S  K  G  I  G  K  I  S  G  V  N  L  T  Q  K
3301 CACCTTAGGAGAAGGGAGTAAAGGTATCGGGAAGATATCAGGAGTAAATCTTACTCAAAA
1031 T  H  P  I  E  V  F  E  P  G  A  E  H  I  V  R  L  M  T  K
3361 GACTCACCCAATAGAGGTATTTGAGCCGGGAGCTGAACATATAGTTCGCCTAATGACTAA
1051 N  W  G  D  N  D  S  I  F  Q  D  V  I  E  T  R  G  R  E  Y
3421 GAATTGGGGCGATAACGATAGCATTTTTCAAGATGTAATTGAGACAAGAGGGAGAGAATA
1071 A  G  L  Y  D  D  I  S  T  Q  G  W  F  I  G  L  M  C  A  I
3481 TGCTGGTTTATATGATGACATCTCCACTCAAGGCTGGTTTATTGGACTGATGTGTGCGAT
1091 A  L  L  T  L  L  L  L  T  V  C  F  V  K  R  N  R  G  G  K
3541 TGCTCTTCTCACACTACTATTATTAACTGTTTGCTTTGTGAAGAGGAATAGAGGTGGAAA
1111 Y  S  V  K  E  K  E  D  L  H  P  D  P  E  I  Q  S  V  K  D
3601 GTACTCAGTTAAAGAAAAGGAAGATTTGCATCCAGACCCAGAAATTCAGTCAGTAAAAGA
1131 E  T  F  G  E  Y  S  D  S  D  E  K  P  L  K  G  S  L  R  S
```

Fig. 2E-4

3661 TGAAACCTTTGGTGAATACAGTGACAGTGATGAAAAGCCTCTCAAAGGAAGCCTTCGGTC
1151 L N R D M Q P T E S A D S L V E Y G E G
3721 CCTTAATAGGGATATGCAGCCTACTGAAAGTGCTGACAGCTTAGTCGAATACGGAGAGGG
1171 D H G L F S E D G S F I G A Y A G S K E
3781 AGACCATGGTCTCTTCAGTGAAGATGGATCATTTATTGGTGCCTACGCTGGATCTAAGGA
1191 K G S V E S N G S S T A T F P L R A *
3841 GAAGGGATCTGTTGAAAGCAATGGAAGTTCTACAGCAACTTTTCCCCTTCGGGCATAAac
3901 acaacatatgtaagcaacgctactggttcaccccaaccttccatatttatctgttcaaag
3961 gagcaagaactttcatataggaatagaaacatgctggccgaagatttcatccagaagtca
4021 acatcctgcaattatgttgaaaagagtagtactttcttcaaaatataaaatgccaagcac
4081 ttcaggcctatgttttgcttatattgttttcaggtgctcaaaatgcaaaacacaaaacaa
4141 atcctgcatttagatacacctcaactaaatccaaagtccccattcagtatattccatatt
4201 tgcctgattttactattcggtgtgtttgcatagatgttgctacttggtgggtttttctcc
4261 gtatgcacattggtatacagtctctgagaactggcttggtgactttgcttcactacaggt
4321 taaaagaccataagcaaactggttatttaaaatgtaaaaaggaatatgaaagtcttatta
4381 aaacacttcattgaaaatatacagtctaaatttattatttaaatttactagcaaaagtc
4441 ttaggtgaacaatcaactagtatttgttgagctcctatttgcccagagatggtcatattt
4501 aaacagaagtatacgtttttcagtttcaacatgaatttttttatttctgtcagttatgac
4561 atccacgagcatcacttttgtgtctgttttttttttttcttggactaaattcaactgc
4621 atggaagcggtggtcagaaggttgttttatacgagaacaggcagaaagtgcccattgttc
4681 aggattctaatagctacatctacttaatatcttcatttctaaattgactgcttttacctt
4741 tttctcatgtttatataatggtatgcttgcatatatttcatgaatacattgtacatatta
4801 tgttaatatttacacaatttaaaatatagatgtgttttattttgaagtgagaaaatgaac
4861 attaacaggcatgtttgtacagctagaatatattagtaagatactgtttttcgtcattcc
4921 agagctacaactaataacacgaggttccaaagctgaagactttgtataaagtatttgggt
4981 tttgttcttgtattgctttctttcaacagtttcaaaataaaatatcatacaaatattgag
5041 ggaaatgttttcatatttttcaaaataggttttattgttgaatgtacatctaccccagc
5101 ccctcaaaagaaaaactgtttacatagaaattcctacacatacgtttgcgtatatgttat
5161 tttaaacatctttgtggtgagaatttttccccgatattctccttctgtcaaagtcagaa
5221 caaattcagggaatttattttctggcagttgtgctccagtccttttaaaattgtacatga
5281 acatgttttagaaacaatatggaggatgatgcatacatgtcggtcaagttcagcgctcga
5341 cattttatggaaagatttttttaaccttaccacgaaatacttaactactgtttaagtgaa
5401 ttgacttatttcactttagtttttgaactgtgattattggtatactgttatatcctcaac
5461 ttggatttatggtaaccccttttagttcatggagaccaaaatttggggtatttataatag
5521 tcagcgcaggaatgcacatggaatatctacttgtccttttgaacctcacgagtcatccag
5581 aatgtatagacaggaaaagcatgtcttatttaaaactgtaatttatgggctcaggatctg
5641 accgcagtcccgggagtaagcatttcaaaggggggaaggcagtgtggtccctaccctgtgt
5701 gaatgtgaggatgtagacatccatcagtgcaactcgagctccatcctcctccgatttcta
5761 aggctccagttttctggagggacagtcatcatgttttgatttatctgggagaaaactgtg
5821 gtgcacagcttgtgaggagggcaaggttgtgacgttcgagcttagttctggtgttattct
5881 gtctcctcttctttgtcatcagccaaaacgtggtttttaaagagagtcatgcaggttaga

Fig. 2E-5

```
5941 aataatgtcaaaaatatttaggaatttaataacctttaagtcagaaactaaaacaaatac
6001 tgaaatattagctcttcctacacttcgtgttcccctttagctgcctgaaaatcaagattg
6061 ctcctactcagatcttctgagtggctaaaacttatggatatgaaaaatgagattgaatga
6121 tgactatgctttgctatcattgttacctttcctcaatactatttggcaactactgggact
6181 cttcagcacaaaaggaatagatctatgattgaccctgattttaattgtgaaattatatga
6241 ttcatatattttatgaatcagaataaccttcaaataaaataaatctaagtcggttaaaat
6301 ggatttcatgattttccctcagaaaatgagtaacggagtccacggcgtgcaatggtaatt
6361 ataaattggtgatgcttgtttgcaaattgcccactcgtgataagtcaacagccaatattt
6421 aaaactttgttcgttactggctttaccctaactttctctagtctactgtcaatatcattt
6481 taatgtaattgattgtatatagtctcaagaatggttggtgggcatgagttcctagagaac
6541 tgtccaagggttgggaaaatccaaattctcttcctggctccagcactgattttgtacata
6601 aacattaggcaggttgcttaaccttttatttcaaactctctcaactctaaagtgctaat
6661 aataatctcagttaccttatctttgtcacagggtgttctttttatgaagaaaaatttga
6721 aaatgataaaagctaagatgccttctaacttcataagcaaacctttaactaattatgtat
6781 ctgaaagtcacccccacataccaactcaactttttcctgtgaacacataaatatatttt
6841 tatagaaaaacaaatctacataaaataaatctactgtttagtgagcagtatgacttgtac
6901 atgccattgaaaattattaatcagaagaaaattaagcagggtctttgctatacaaaagtg
6961 ttttccactaattttgcatgcgtatttataagaaaaatgtgaatttggtggttttattct
7021 atcggtataaaggcatcgatatttagatgcacccgtgtttgtaaaaatgtagagcacaa
7081 tggaattatgctggaagtctcaaataatattttttcctattttatactcatggaagaga
7141 taagctaaagaggggacaataatgagaaatgttggtgtgcttttctaagcatttaaaaca
7201 taattgccaattgaaaccctaaatatgtttacataccattaagatatgattcatgtaaca
7261 atgttaaattaattataatgggattgggtttgttatctgtggtagtatatatcctagtgt
7321 tcctatagtgaaataagtagggttcagccaaagctttctttgttttgtaccttaaattgt
7381 tcgattacgtcatcaaaagagatgaaaggtatgtagaacaggttcacgtgattaccttt
7441 tcttttggcttggattaatattcatagtagaactttataaaacgtgtttgtattgtaggt
7501 ggtgtttgtattatgcttatgactatgtatggtttgaaaatattttcattatacatgaaa
7561 ttcaactttccaaataaaagttctacttcatgtaatccaaaa
```

Fig. 2F-1. The cDNA (SEQ ID. NO.: 12) and amino acid sequence (SEQ ID. NO.: 13) of 282P1G3 v.6. The Kozak initiation sequence is shown in bold, and the start methionine is underlined. The open reading frame extends from nucleic acid 272-3823 including the stop codon.

```
   1 cggaccctgcgcgcccccgtcccggctcccggccggctcgggggagaaggcgcccgaggg
  61 gaggcgccggacagatcgcgtttcggaggcggcgcaggtgctgtaaactgcaaaccataa
 121 tcctgtcttaatactgcaaacaaatcatagtggaactaaggggaacttaatttactgttt
 181 ccaggttaactaaggtctcagctgtaaaccaaaagtgagaggagacattaagattttcat
   1                               M  E  P  L  L  G  R  G  L
 241 tcttaccgggttgtcttcttcctgaagagcaATGGAGCCGCTTTTACTTGGAAGAGGACT
  11  I  V  Y  L  M  F  L  L  L  K  F  S  K  A  I  E  I  P  S  S
```

Fig. 2F-2

```
301 AATCGTATATCTAATGTTCCTCCTGTTAAAATTCTCAAAAGCAATTGAAATACCATCTTC
 31  V  Q  Q  V  P  T  I  I  K  Q  S  K  V  Q  V  A  F  P  F  D
361 AGTTCAACAGGTTCCAACAATCATAAAACAGTCAAAAGTCCAAGTTGCCTTTCCCTTCGA
 51  E  Y  F  Q  I  E  C  E  A  K  G  N  P  E  P  T  F  S  W  T
421 TGAGTATTTTCAAATTGAATGTGAAGCTAAAGGAAATCCAGAACCAACATTTTCGTGGAC
 71  K  D  G  N  P  F  Y  F  T  D  H  R  I  I  P  S  N  N  S  G
481 TAAGGATGGCAACCCTTTTTATTTCACTGACCATCGGATAATTCCATCGAACAATTCAGG
 91  T  F  R  I  P  N  E  G  H  I  S  H  F  Q  G  K  Y  R  C  F
541 AACATTCAGGATCCCAAACGAGGGGCACATATCTCACTTTCAAGGGAAATACCGCTGCTT
111  A  S  N  K  L  G  I  A  M  S  E  E  I  E  F  I  V  P  K  L
601 TGCTTCAAATAAACTGGGAATCGCTATGTCAGAAGAAATAGAATTTATAGTTCCAAAATT
131  E  H  I  E  Q  D  E  R  V  Y  M  S  Q  K  G  D  L  Y  F  A
661 AGAACACATCGAACAAGATGAAAGAGTATACATGAGCCAAAAGGGAGATCTATACTTCGC
151  N  V  E  E  K  D  S  R  N  D  Y  C  C  F  A  A  F  P  R  L
721 AAACGTGGAAGAAAAGGACAGTCGCAATGACTACTGTTGCTTTGCTGCATTTCCAAGATT
171  R  T  I  V  Q  K  M  P  M  K  L  T  V  N  S  L  K  H  A  N
781 AAGGACTATTGTACAGAAAATGCCAATGAAACTAACAGTTAACAGTTTAAAGCATGCTAA
191  D  S  S  S  S  T  E  I  G  S  K  A  N  S  I  K  Q  R  K  P
841 TGACTCAAGTTCATCCACAGAAATTGGTTCCAAGGCAAATTCCATCAAGCAAAGAAAACC
211  K  L  L  L  P  P  T  E  S  G  S  E  S  S  I  T  I  L  K  G
901 CAAACTGCTGTTGCCTCCCACTGAGAGTGGCAGTGAGTCTTCAATTACCATCCTCAAAGG
231  E  I  L  L  L  E  C  F  A  E  G  L  P  T  P  Q  V  D  W  N
961 GGAAATCTTGCTGCTTGAGTGTTTTGCTGAAGGCTTGCCAACTCCACAGGTTGATTGGAA
251  K  I  G  G  D  L  P  K  G  R  E  T  K  E  N  Y  G  K  T  L
1021 CAAAATTGGTGGTGACTTACCAAAGGGGAGAGAAACAAAAGAAAATTATGGCAAGACTTT
271  K  I  E  N  V  S  Y  Q  D  K  G  N  Y  R  C  T  A  S  N  F
1081 GAAGATAGAGAATGTCTCCTACCAGGACAAAGGAAATTATCGCTGCACAGCCAGCAATTT
291  L  G  T  A  T  H  D  F  H  V  I  V  E  E  P  P  R  W  T  K
1141 CTTGGGAACAGCCACTCACGATTTTCACGTTATAGTAGAAGAGCCTCCTCGCTGGACAAA
311  K  P  Q  S  A  V  Y  S  T  G  S  N  G  I  L  L  C  E  A  E
1201 GAAGCCTCAGAGTGCTGTGTATAGCACCGGAAGCAATGGCATCTTGTTATGTGAGGCTGA
331  G  E  P  Q  P  T  I  K  W  R  V  N  G  S  P  V  D  N  H  P
1261 AGGAGAACCTCAACCCACAATCAAGTGGAGAGTCAATGGCTCCCCAGTTGACAATCATCC
351  F  A  G  D  V  V  F  P  R  E  I  S  F  T  N  L  Q  P  N  H
1321 ATTTGCTGGTGATGTTGTCTTCCCCAGGGAAATCAGTTTTACCAACCTTCAACCAAATCA
371  T  A  V  Y  Q  C  E  A  S  N  V  H  G  T  I  L  A  N  A  N
1381 TACTGCTGTGTACCAGTGTGAAGCCTCAAATGTCCATGGAACTATCCTTGCCAATGCCAA
391  I  D  V  V  D  V  R  P  L  I  Q  T  K  D  G  E  N  Y  A  T
1441 TATTGATGTTGTGGATGTCCGTCCATTGATACAAACCAAAGATGGAGAAAATTACGCTAC
411  V  V  G  Y  S  A  F  L  H  C  E  F  F  A  S  P  E  A  V  V
1501 AGTGGTTGGGTACAGTGCTTTCTTACATTGCGAGTTCTTTGCTTCACCTGAGGCAGTCGT
```

Fig. 2F-3

```
 431  S  W  Q  K  V  E  E  V  K  P  L  E  G  R  R  Y  H  I  Y  E
1561 GTCCTGGCAGAAGGTGGAAGAAGTGAAACCCCTGGAGGGCAGGCGGTATCATATCTATGA
 451  N  G  T  L  Q  I  N  R  T  T  E  E  D  A  G  S  Y  S  C  W
1621 AAATGGCACATTGCAGATCAACAGAACCACCGAAGAAGATGCTGGGTCTTACTCATGTTG
 471  V  E  N  A  I  G  K  T  A  V  T  A  N  L  D  I  R  N  A  T
1681 GGTAGAAAATGCTATAGGAAAAACTGCAGTCACAGCCAATTTGGATATTAGAAATGCTAC
 491  K  L  R  V  S  P  K  N  P  R  I  P  K  L  H  M  L  E  L  H
1741 AAAACTTAGAGTTTCTCCTAAGAATCCTCGTATCCCCAAATTGCATATGCTTGAATTACA
 511  C  E  S  K  C  D  S  H  L  K  H  S  L  K  L  S  W  S  K  D
1801 TTGTGAAAGCAAATGTGACTCACATTTGAAACACAGTTTGAAGTTGTCCTGGAGTAAAGA
 531  G  E  A  F  E  I  N  G  T  E  D  G  R  I  I  I  D  G  A  N
1861 TGGAGAAGCCTTTGAAATTAATGGCACAGAAGATGGCAGGATAATTATTGATGGAGCTAA
 551  L  T  I  S  N  V  T  L  E  D  Q  G  I  Y  C  C  S  A  H  T
1921 TTTGACCATATCTAATGTAACTTTAGAGGACCAAGGTATTTACTGCTGTTCAGCTCATAC
 571  A  L  D  S  A  A  D  I  T  Q  V  T  V  L  D  V  P  D  P  P
1981 TGCTCTAGACAGTGCTGCCGATATAACTCAAGTAACTGTTCTTGATGTTCCGGATCCACC
 591  E  N  L  H  L  S  E  R  Q  N  R  S  V  R  L  T  W  E  A  G
2041 AGAAAACCTTCACTTGTCTGAAAGACAGAACAGGAGTGTTCGGCTGACCTGGGAAGCTGG
 611  A  D  H  N  S  N  I  S  E  Y  I  V  E  F  E  G  N  K  E  E
2101 AGCTGACCACAACAGCAATATTAGCGAGTATATTGTTGAATTTGAAGGAAACAAAGAAGA
 631  P  G  R  W  E  E  L  T  R  V  Q  G  K  K  T  T  V  I  L  P
2161 GCCTGGAAGGTGGGAGGAACTGACCAGAGTCCAAGGAAAGAAAACCACAGTTATCTTACC
 651  L  A  P  F  V  R  Y  Q  F  R  V  I  A  V  N  E  V  G  R  S
2221 TTTGGCTCCATTTGTGAGATACCAGTTCAGGGTCATAGCCGTGAACGAAGTAGGGAGAAG
 671  Q  P  S  Q  P  S  D  H  H  E  T  P  P  A  A  P  D  R  N  P
2281 TCAGCCTAGCCAGCCGTCAGACCATCATGAAACACCACCAGCAGCTCCAGATAGGAATCC
 691  Q  N  I  R  V  Q  A  S  Q  P  K  E  M  I  I  K  W  E  P  L
2341 ACAAAACATAAGGGTTCAAGCCTCTCAACCCAAGGAAATGATTATAAAGTGGGAGCCTTT
 711  K  S  M  E  Q  N  G  P  G  L  E  Y  R  V  T  W  K  P  Q  G
2401 GAAATCCATGGAGCAGAATGGACCAGGCCTAGAGTACAGAGTGACCTGGAAGCCACAGGG
 731  A  P  V  E  W  E  E  E  T  V  T  N  H  T  L  R  V  M  T  P
2461 AGCCCCAGTGGAGTGGGAAGAAGAAACAGTCACAAACCACACATTGCGGGTGATGACGCC
 751  A  V  Y  A  P  Y  D  V  K  V  Q  A  I  N  Q  L  G  S  G  P
2521 TGCTGTCTATGCCCCTTATGATGTCAAGGTCCAGGCTATCAATCAACTAGGATCTGGGCC
 771  D  P  Q  S  V  T  L  Y  S  G  E  D  Y  P  D  T  A  P  V  I
2581 TGACCCTCAGTCAGTGACTCTCTATTCTGGAGAAGACTATCCTGATACAGCTCCAGTGAT
 791  H  G  V  D  V  I  N  S  T  L  V  K  V  T  W  S  T  V  P  K
2641 CCATGGGGTGGACGTTATAAACAGTACATTAGTTAAAGTTACCTGGTCAACAGTTCCAAA
 811  D  R  V  H  G  R  L  K  G  Y  Q  I  N  W  W  K  T  K  S  L
2701 GGACAGAGTACATGGACGTCTGAAAGGCTATCAGATAAATTGGTGGAAAACAAAAAGTCT
 831  L  D  G  R  T  H  P  K  E  V  N  I  L  R  F  S  G  Q  R  N
```

Fig. 2F-4

```
2761 GTTGGATGGAAGAACACATCCCAAAGAAGTGAACATTCTAAGATTTTCAGGACAAAGAAA
 851  S  G  M  V  P  S  L  D  A  F  S  E  F  H  L  T  V  L  A  Y
2821 CTCTGGAATGGTTCCTTCCTTAGATGCCTTTAGTGAATTTCATTTAACAGTCTTAGCCTA
 871  N  S  K  G  A  G  P  E  S  E  P  Y  I  F  Q  T  P  E  G  V
2881 TAACTCTAAAGGAGCTGGTCCTGAAAGTGAGCCTTATATATTTCAAACACCAGAAGGAGT
 891  P  E  Q  P  T  F  L  K  V  I  K  V  D  K  D  T  A  T  L  S
2941 ACCTGAACAGCCAACTTTTCTAAAGGTCATCAAAGTTGATAAAGACACTGCCACTTTATC
 911  W  G  L  P  K  K  L  N  G  N  L  T  G  Y  L  L  Q  Y  Q  I
3001 TTGGGGACTACCTAAGAAATTAAATGGAAACTTAACTGGCTATCTTTTGCAATATCAGAT
 931  I  N  D  T  Y  E  I  G  E  L  N  D  I  N  I  T  T  P  S  K
3061 AATAAATGACACCTACGAGATTGGAGAATTAAATGATATTAACATTACAACTCCATCAAA
 951  P  S  W  H  L  S  N  L  N  A  T  T  K  Y  K  F  Y  L  R  A
3121 GCCCAGCTGGCACCTCTCAAACCTGAATGCAACTACCAAGTACAAATTCTACTTGAGGGC
 971  C  T  S  Q  G  C  G  K  P  I  T  E  E  S  S  T  L  G  E  G
3181 TTGCACTTCACAGGGCTGTGGAAAACCGATCACGGAGGAAAGCTCCACCTTAGGAGAAGG
 991  S  K  G  I  G  K  I  S  G  V  N  L  T  Q  K  T  H  P  I  E
3241 GAGTAAAGGTATCGGGAAGATATCAGGAGTAAATCTTACTCAAAAGACTCACCCAATAGA
1011  V  F  E  P  G  A  E  H  I  V  R  L  M  T  K  N  W  G  D  N
3301 GGTATTTGAGCCGGGAGCTGAACATATAGTTCGCCTAATGACTAAGAATTGGGGCGATAA
1031  D  S  I  F  Q  D  V  I  E  T  R  G  R  E  Y  A  G  L  Y  D
3361 CGATAGCATTTTTCAAGATGTAATTGAGACAAGAGGGAGAGAATATGCTGGTTTATATGA
1051  D  I  S  T  Q  G  W  F  I  G  L  M  C  A  I  A  L  L  T  L
3421 TGACATCTCCACTCAAGGCTGGTTTATTGGACTGATGTGTGCGATTGCTCTTCTCACACT
1071  L  L  L  T  V  C  F  V  K  R  N  R  G  G  K  Y  S  V  K  E
3481 ACTATTATTAACTGTTTGCTTTGTGAAGAGGAATAGAGGTGGAAAGTACTCAGTTAAAGA
1091  K  E  D  L  H  P  D  P  E  I  Q  S  V  K  D  E  T  F  G  E
3541 AAAGGAAGATTTGCATCCAGACCCAGAAATTCAGTCAGTAAAAGATGAAACCTTTGGTGA
1111  Y  S  D  S  D  E  K  P  L  K  G  S  L  R  S  L  N  R  D  M
3601 ATACAGTGACAGTGATGAAAAGCCTCTCAAAGGAAGCCTTCGGTCCCTTAATAGGGATAT
1131  Q  P  T  E  S  A  D  S  L  V  E  Y  G  E  G  D  H  G  L  F
3661 GCAGCCTACTGAAAGTGCTGACAGCTTAGTCGAATACGGAGAGGGAGACCATGGTCTCTT
1151  S  E  D  G  S  F  I  G  A  Y  A  G  S  K  E  K  G  S  V  E
3721 CAGTGAAGATGGATCATTTATTGGTGCCTACGCTGGATCTAAGGAGAAGGGATCTGTTGA
1171  S  N  G  S  S  T  A  T  F  P  L  R  A  *
3781 AAGCAATGGAAGTTCTACAGCAACTTTTCCCCTTCGGGCATAAacacaacatatgtaagc
3841 aacgctactggttcaccccaaccttccatatttatctgttcaaaggagcaagaactttca
3901 tataggaatagaaacatgctggccgaagatttcatccagaagtcaacatcctgcaattat
3961 gttgaaaagagtagtactttcttcaaaatataaaatgccaagcacttcaggcctatgttt
4021 tgcttatattgttttcaggtgctcaaaatgcaaaacacaaaacaaatcctgcatttagat
4081 acacctcaactaaatccaaagtccccattcagtatattccatatttgcctgattttacta
4141 ttcggtgtgtttgcatagatgttgctacttggtgggtttttctccgtatgcacattggta
```

Fig. 2F-5

4201 tacagtctctgagaactggcttggtgactttgcttcactacaggttaaaagaccataagc
4261 aaactggttatttaaaatgtaaaaaggaatatgaaagtcttattaaaacacttcattgaa
4321 aatatacagtctaaatttattatttaaattttactagcaaaagtcttaggtgaacaatca
4381 actagtatttgttgagctcctatttgcccagagatggtcatatttaaacagaagtatacg
4441 tttttcagtttcaacatgaatttttttatttctgtcagttatgacatccacgagcatcac
4501 tttttgtgtctgtttttttttttttcttggactaaattcaactgcatggaagcggtggtc
4561 agaaggttgttttatacgagaacaggcagaaagtgcccattgttcaggattctaatagct
4621 acatctacttaatatcttcatttctaaattgactgcttttaccttttttctcatgtttata
4681 taatggtatgcttgcatatatttcatgaatacattgtacatattatgttaatatttacac
4741 aatttaaaatatagatgtgtttattttgaagtgagaaaatgaacattaacaggcatgtt
4801 tgtacagctagaatatattagtaagatactgtttttcgtcattccagagctacaactaat
4861 aacacgaggttccaaagctgaagactttgtataaagtatttgggttttgttcttgtattg
4921 ctttctttcaacagtttcaaaataaaatatcatacaaatattgagggaaatgttttcata
4981 tttttcaaaataggttttttattgttgaatgtacatctaccccagcccctcaaaagaaaaa
5041 ctgtttacatagaaattcctacacatacgtttgcgtatatgttattttaaacatctttgt
5101 ggtgagaatttttttccccgatattctccttctgtcaaagtcagaacaaattcagggaatt
5161 tattttctggcagttgtgctccagtccttttaaaattgtacatgaacatgttttagaaac
5221 aatatggaggatgatgcatacatgtcggtcaagttcagcgctcgacattttatggaaaga
5281 ttttttaaccttaccacgaaatacttaactactgtttaagtgaattgacttatttcact
5341 ttagtttttgaactgtgattattggtatactgttatatcctcaacttggatttatggtaa
5401 ccccttttagttcatggagaccaaaatttggggtatttataatagtcagcgcaggaatgc
5461 acatggaatatctacttgtccttttgaacctcacgagtcatccagaatgtatagacagga
5521 aaagcatgtcttatttaaaactgtaatttatgggctcaggatctgaccgcagtcccggga
5581 gtaagcatttcaaagggggaaggcagtgtggtccctaccctgtgtgaatgtgaggatgta
5641 gacatccatcagtgcaactcgagctccatcctcctccgatttctaaggctccagttttct
5701 ggagggacagtcatcatgttttgatttatctgggagaaaactgtggtgcacagcttgtga
5761 ggagggcaaggttgtgacgttcgagcttagttctggtgttattctgtctcctcttctttg
5821 tcatcagccaaaacgtggtttttaaagagagtcatgcaggttagaaataatgtcaaaaat
5881 atttaggaatttaataacctttaagtcagaaactaaaacaaatactgaaatattagctct
5941 tcctacacttcgtgttcccctttagctgcctgaaaatcaagattgctcctactcagatct
6001 tctgagtggctaaaacttatggatatgaaaaatgagattgaatgatgactatgctttgct
6061 atcattgttacctttcctcaatactatttggcaactactgggactcttcagcacaaaagg
6121 aatagatctatgattgaccctgatttaattgtgaaattatatgattcatatattttatg
6181 aatcagaataaccttcaaataaaataaatctaagtcggttaaaatggatttcatgatttt
6241 ccctcagaaaatgagtaacggagtccacggcgtgcaatggtaattataaattggtgatgc
6301 ttgtttgcaaattgcccactcgtgataagtcaacagccaatatttaaaactttgttcgtt
6361 actggctttaccctaactttctctagtctactgtcaatatcattttaatgtaattgattg
6421 tatatagtctcaagaatggttggtgggcatgagttcctagagaactgtccaagggttggg
6481 aaaatccaaattctcttcctggctccagcactgattttgtacataaacattaggcaggtt
6541 gcttaaccttttttatttcaaactctctcaactctaaagtgctaataataatctcagttac
6601 cttatctttgtcacagggtgttctttttttatgaagaaaaatttgaaaatgataaaagcta

Fig. 2F-6

```
6661 agatgccttctaacttcataagcaaacctttaactaattatgtatctgaaagtcaccccc
6721 acataccaactcaactttttcctgtgaacacataaatatatttttatagaaaaacaaat
6781 ctacataaaataaatctactgtttagtgagcagtatgacttgtacatgccattgaaaatt
6841 attaatcagaagaaaattaagcagggtctttgctatacaaaagtgttttccactaatttt
6901 gcatgcgtatttataagaaaaatgtgaatttggtggttttattctatcggtataaaggca
6961 tcgatattttagatgcacccgtgtttgtaaaaatgtagagcacaatggaattatgctgga
7021 agtctcaaataatattttttcctattttatactcatggaagagataagctaaagagggg
7081 acaataatgagaaatgttggtgtgcttttctaagcatttaaaacataattgccaattgaa
7141 accctaaatatgtttacataccattaagatatgattcatgtaacaatgttaaattaatta
7201 taatgggattgggtttgttatctgtggtagtatatatcctagtgttcctatagtgaaata
7261 agtagggttcagccaaagctttctttgttttgtaccttaaattgttcgattacgtcatca
7321 aaagagatgaaaggtatgtagaacaggttcacgtgattacctttttcttttggcttggat
7381 taatattcatagtagaactttataaaacgtgtttgtattgtaggtggtgtttgtattatg
7441 cttatgactatgtatggtttgaaaatattttcattatacatgaaattcaactttccaaat
7501 aaaagttctacttcatgtaatccaaaa
```

Fig. 2G-1. The cDNA (SEQ ID. NO.: 14) and amino acid sequence (SEQ ID. NO.: 15) of 282P1G3 v.7. The Kozak initiation sequence is shown in bold, and the start methionine is underlined. The open reading frame extends from nucleic acid 272-3982 including the stop codon.

```
  1 cggaccctgcgcgccccccgtcccggctcccggccggctcgggggagaaggcgcccgaggg
 61 gaggcgccggacagatcgcgtttcggaggcggcgcaggtgctgtaaactgcaaaccataa
121 tcctgtcttaatactgcaaacaaatcatagtggaactaaggggaacttaatttactgttt
181 ccaggttaactaaggtctcagctgtaaaccaaaagtgagaggagacattaagattttcat
  1                                 M  E  P  L  L  L  G  R  G  L
241 tcttaccgggttgtcttcttcctgaagagcaATGGAGCCGCTTTTACTTGGAAGAGGACT
 11  I  V  Y  L  M  F  L  L  L  K  F  S  K  A  I  E  I  P  S  S
301 AATCGTATATCTAATGTTCCTCCTGTTAAAATTCTCAAAAGCAATTGAAATACCATCTTC
 31  V  Q  Q  V  P  T  I  I  K  Q  S  K  V  Q  V  A  F  P  F  D
361 AGTTCAACAGGTTCCAACAATCATAAAACAGTCAAAAGTCCAAGTTGCCTTTCCCTTCGA
 51  E  Y  F  Q  I  E  C  E  A  K  G  N  P  E  P  T  F  S  W  T
421 TGAGTATTTTCAAATTGAATGTGAAGCTAAAGGAAATCCAGAACCAACATTTTCGTGGAC
 71  K  D  G  N  P  F  Y  F  T  D  H  R  I  I  P  S  N  N  S  G
481 TAAGGATGGCAACCCTTTTTATTTCACTGACCATCGGATAATTCCATCGAACAATTCAGG
 91  T  F  R  I  P  N  E  G  H  I  S  H  F  Q  G  K  Y  R  C  F
541 AACATTCAGGATCCCAAACGAGGGGCACATATCTCACTTTCAAGGGAAATACCGCTGCTT
111  A  S  N  K  L  G  I  A  M  S  E  E  I  E  F  I  V  P  S  V
601 TGCTTCAAATAAACTGGGAATCGCTATGTCAGAAGAAATAGAATTTATAGTTCCAAGTGT
131  P  K  L  P  K  E  K  I  D  P  L  E  V  E  E  G  D  P  I  V
661 TCCAAAACTCCCAAAAGAAAAAATTGACCCTCTTGAAGTGGAGGAGGGAGATCCAATTGT
```

Fig. 2G-2

```
151  L  P  C  N  P  P  K  G  L  P  P  L  H  I  Y  W  M  N  I  E
721  CCTCCCATGCAATCCTCCCAAAGGCCTCCCACCTTTACACATTTATTGGATGAATATTGA
171  L  E  H  I  E  Q  D  E  R  V  Y  M  S  Q  K  G  D  L  Y  F
781  ATTAGAACACATCGAACAAGATGAAAGAGTATACATGAGCCAAAAGGGAGATCTATACTT
191  A  N  V  E  E  K  D  S  R  N  D  Y  C  C  F  A  A  F  P  R
841  CGCAAACGTGGAAGAAAAGGACAGTCGCAATGACTACTGTTGCTTTGCTGCATTTCCAAG
211  L  R  T  I  V  Q  K  M  P  M  K  L  T  V  N  S  L  K  H  A
901  ATTAAGGACTATTGTACAGAAAATGCCAATGAAACTAACAGTTAACAGTTTAAAGCATGC
231  N  D  S  S  S  S  T  E  I  G  S  K  A  N  S  I  K  Q  R  K
961  TAATGACTCAAGTTCATCCACAGAAATTGGTTCCAAGGCAAATTCCATCAAGCAAAGAAA
251  P  K  L  L  L  P  P  T  E  S  G  S  E  S  S  I  T  I  L  K
1021 ACCCAAACTGCTGTTGCCTCCCACTGAGAGTGGCAGTGAGTCTTCAATTACCATCCTCAA
271  G  E  I  L  L  L  E  C  F  A  E  G  L  P  T  P  Q  V  D  W
1081 AGGGGAAATCTTGCTGCTTGAGTGTTTTGCTGAAGGCTTGCCAACTCCACAGGTTGATTG
291  N  K  I  G  G  D  L  P  K  G  R  E  T  K  E  N  Y  G  K  T
1141 GAACAAAATTGGTGGTGACTTACCAAAGGGGAGAGAAACAAAAGAAAATTATGGCAAGAC
311  L  K  I  E  N  V  S  Y  Q  D  K  G  N  Y  R  C  T  A  S  N
1201 TTTGAAGATAGAGAATGTCTCCTACCAGGACAAAGGAAATTATCGCTGCACAGCCAGCAA
331  F  L  G  T  A  T  H  D  F  H  V  I  V  E  D  N  I  S  H  E
1261 TTTCTTGGGAACAGCCACTCACGATTTTCACGTTATAGTAGAAGATAACATCTCTCATGA
351  L  F  T  L  H  P  E  P  P  R  W  T  K  K  P  Q  S  A  V  Y
1321 GCTCTTCACTTTACATCCAGAGCCTCCTCGCTGGACAAAGAAGCCTCAGAGTGCTGTGTA
371  S  T  G  S  N  G  I  L  L  C  E  A  E  G  E  P  Q  P  T  I
1381 TAGCACCGGAAGCAATGGCATCTTGTTATGTGAGGCTGAAGGAGAACCTCAACCCACAAT
391  K  W  R  V  N  G  S  P  V  D  N  H  P  F  A  G  D  V  V  F
1441 CAAGTGGAGAGTCAATGGCTCCCCAGTTGACAATCATCCATTTGCTGGTGATGTTGTCTT
411  P  R  E  I  S  F  T  N  L  Q  P  N  H  T  A  V  Y  Q  C  E
1501 CCCCAGGGAAATCAGTTTTACCAACCTTCAACCAAATCATACTGCTGTGTACCAGTGTGA
431  A  S  N  V  H  G  T  I  L  A  N  A  N  I  D  V  V  D  V  R
1561 AGCCTCAAATGTCCATGGAACTATCCTTGCCAATGCCAATATTGATGTTGTGGATGTCCG
451  P  L  I  Q  T  K  D  G  E  N  Y  A  T  V  V  G  Y  S  A  F
1621 TCCATTGATACAAACCAAAGATGGAGAAAATTACGCTACAGTGGTTGGGTACAGTGCTTT
471  L  H  C  E  F  F  A  S  P  E  A  V  V  S  W  Q  K  V  E  E
1681 CTTACATTGCGAGTTCTTTGCTTCACCTGAGGCAGTCGTGTCCTGGCAGAAGGTGGAAGA
491  V  K  P  L  E  G  R  R  Y  H  I  Y  E  N  G  T  L  Q  I  N
1741 AGTGAAACCCCTGGAGGGCAGGCGGTATCATATCTATGAAAATGGCACATTGCAGATCAA
511  R  T  T  E  E  D  A  G  S  Y  S  C  W  V  E  N  A  I  G  K
1801 CAGAACCACCGAAGAAGATGCTGGGTCTTACTCATGTTGGGTAGAAAATGCTATAGGAAA
531  T  A  V  T  A  N  L  D  I  R  N  A  T  K  L  R  V  S  P  K
1861 AACTGCAGTCACAGCCAATTTGGATATTAGAAATGCTACAAAACTTAGAGTTTCTCCTAA
551  N  P  R  I  P  K  L  H  M  L  E  L  H  C  E  S  K  C  D  S
```

Fig. 2G-3

```
1921 GAATCCTCGTATCCCCAAATTGCATATGCTTGAATTACATTGTGAAAGCAAATGTGACTC
 571  H  L  K  H  S  L  K  L  S  W  S  K  D  G  E  A  F  E  I  N
1981 ACATTTGAAACACAGTTTGAAGTTGTCCTGGAGTAAAGATGGAGAAGCCTTTGAAATTAA
 591  G  T  E  D  G  R  I  I  I  D  G  A  N  L  T  I  S  N  V  T
2041 TGGCACAGAAGATGGCAGGATAATTATTGATGGAGCTAATTTGACCATATCTAATGTAAC
 611  L  E  D  Q  G  I  Y  C  C  S  A  H  T  A  L  D  S  A  A  D
2101 TTTAGAGGACCAAGGTATTTACTGCTGTTCAGCTCATACTGCTCTAGACAGTGCTGCCGA
 631  I  T  Q  V  T  V  L  D  V  P  D  P  P  E  N  L  H  L  S  E
2161 TATAACTCAAGTAACTGTTCTTGATGTTCCGGATCCACCAGAAAACCTTCACTTGTCTGA
 651  R  Q  N  R  S  V  R  L  T  W  E  A  G  A  D  H  N  S  N  I
2221 AAGACAGAACAGGAGTGTTCGGCTGACCTGGGAAGCTGGAGCTGACCACAACAGCAATAT
 671  S  E  Y  I  V  E  F  E  G  N  K  E  E  P  G  R  W  E  E  L
2281 TAGCGAGTATATTGTTGAATTTGAAGGAAACAAAGAAGAGCCTGGAAGGTGGGAGGAACT
 691  T  R  V  Q  G  K  K  T  T  V  I  L  P  L  A  P  F  V  R  Y
2341 GACCAGAGTCCAAGGAAAGAAAACCACAGTTATCTTACCTTTGGCTCCATTTGTGAGATA
 711  Q  F  R  V  I  A  V  N  E  V  G  R  S  Q  P  S  Q  P  S  D
2401 CCAGTTCAGGGTCATAGCCGTGAACGAAGTAGGGAGAAGTCAGCCTAGCCAGCCGTCAGA
 731  H  H  E  T  P  P  A  A  P  D  R  N  P  Q  N  I  R  V  Q  A
2461 CCATCATGAAACACCACCAGCAGCTCCAGATAGGAATCCACAAAACATAAGGGTTCAAGC
 751  S  Q  P  K  E  M  I  I  K  W  E  P  L  K  S  M  E  Q  N  G
2521 CTCTCAACCCAAGGAAATGATTATAAAGTGGGAGCCTTTGAAATCCATGGAGCAGAATGG
 771  P  G  L  E  Y  R  V  T  W  K  P  Q  G  A  P  V  E  W  E  E
2581 ACCAGGCCTAGAGTACAGAGTGACCTGGAAGCCACAGGGAGCCCCAGTGGAGTGGGAAGA
 791  E  T  V  T  N  H  T  L  R  V  M  T  P  A  V  Y  A  P  Y  D
2641 AGAAACAGTCACAAACCACACATTGCGGGTGATGACGCCTGCTGTCTATGCCCCTTATGA
 811  V  K  V  Q  A  I  N  Q  L  G  S  G  P  D  P  Q  S  V  T  L
2701 TGTCAAGGTCCAGGCTATCAATCAACTAGGATCTGGGCCTGACCCTCAGTCAGTGACTCT
 831  Y  S  G  E  D  Y  P  D  T  A  P  V  I  H  G  V  D  V  I  N
2761 CTATTCTGGAGAAGACTATCCTGATACAGCTCCAGTGATCCATGGGGTGGACGTTATAAA
 851  S  T  L  V  K  V  T  W  S  T  V  P  K  D  R  V  H  G  R  L
2821 CAGTACATTAGTTAAAGTTACCTGGTCAACAGTTCCAAAGGACAGAGTACATGGACGTCT
 871  K  G  Y  Q  I  N  W  W  K  T  K  S  L  L  D  G  R  T  H  P
2881 GAAAGGCTATCAGATAAATTGGTGGAAAACAAAAAGTCTGTTGGATGGAAGAACACATCC
 891  K  E  V  N  I  L  R  F  S  G  Q  R  N  S  G  M  V  P  S  L
2941 CAAAGAAGTGAACATTCTAAGATTTTCAGGACAAAGAAACTCTGGAATGGTTCCTTCCTT
 911  D  A  F  S  E  F  H  L  T  V  L  A  Y  N  S  K  G  A  G  P
3001 AGATGCCTTTAGTGAATTTCATTTAACAGTCTTAGCCTATAACTCTAAAGGAGCTGGTCC
 931  E  S  E  P  Y  I  F  Q  T  P  E  G  V  P  E  Q  P  T  F  L
3061 TGAAAGTGAGCCTTATATATTTCAAACACCAGAAGGAGTACCTGAACAGCCAACTTTTCT
 951  K  V  I  K  V  D  K  D  T  A  T  L  S  W  G  L  P  K  K  L
3121 AAAGGTCATCAAAGTTGATAAAGACACTGCCACTTTATCTTGGGGACTACCTAAGAAATT
```

Fig. 2G-4

```
971  N  G  N  L  T  G  Y  L  L  Q  Y  Q  I  I  N  D  T  Y  E  I
3181 AAATGGAAACTTAACTGGCTATCTTTTGCAATATCAGATAATAAATGACACCTACGAGAT
991  G  E  L  N  D  I  N  I  T  T  P  S  K  P  S  W  H  L  S  N
3241 TGGAGAATTAAATGATATTAACATTACAACTCCATCAAAGCCCAGCTGGCACCTCTCAAA
1011 L  N  A  T  T  K  Y  K  F  Y  L  R  A  C  T  S  Q  G  C  G
3301 CCTGAATGCAACTACCAAGTACAAATTCTACTTGAGGGCTTGCACTTCACAGGGCTGTGG
1031 K  P  I  T  E  E  S  S  T  L  G  E  G  S  K  G  I  G  K  I
3361 AAAACCGATCACGGAGGAAAGCTCCACCTTAGGAGAAGGGAGTAAAGGTATCGGGAAGAT
1051 S  G  V  N  L  T  Q  K  T  H  P  I  E  V  F  E  P  G  A  E
3421 ATCAGGAGTAAATCTTACTCAAAAGACTCACCCAATAGAGGTATTTGAGCCGGGAGCTGA
1071 H  I  V  R  L  M  T  K  N  W  G  D  N  D  S  I  F  Q  D  V
3481 ACATATAGTTCGCCTAATGACTAAGAATTGGGGCGATAACGATAGCATTTTTCAAGATGT
1091 I  E  T  R  G  R  E  Y  A  G  L  Y  D  D  I  S  T  Q  G  W
3541 AATTGAGACAAGAGGGAGAGAATATGCTGGTTTATATGATGACATCTCCACTCAAGGCTG
1111 F  I  G  L  M  C  A  I  A  L  L  T  L  L  L  L  T  V  C  F
3601 GTTTATTGGACTGATGTGTGCGATTGCTCTTCTCACACTACTATTATTAACTGTTTGCTT
1131 V  K  R  N  R  G  G  K  Y  S  V  K  E  K  E  D  L  H  P  D
3661 TGTGAAGAGGAATAGAGGTGGAAAGTACTCAGTTAAAGAAAAGGAAGATTTGCATCCAGA
1151 P  E  I  Q  S  V  K  D  E  T  F  G  E  Y  S  D  S  D  E  K
3721 CCCAGAAATTCAGTCAGTAAAAGATGAAACCTTTGGTGAATACAGTGACAGTGATGAAAA
1171 P  L  K  G  S  L  R  S  L  N  R  D  M  Q  P  T  E  S  A  D
3781 GCCTCTCAAAGGAAGCCTTCGGTCCCTTAATAGGGATATGCAGCCTACTGAAAGTGCTGA
1191 S  L  V  E  Y  G  E  G  D  H  G  L  F  S  E  D  G  S  F  I
3841 CAGCTTAGTCGAATACGGAGAGGGAGACCATGGTCTCTTCAGTGAAGATGGATCATTTAT
1211 G  A  Y  A  G  S  K  E  K  G  S  V  E  S  N  G  S  S  T  A
3901 TGGTGCCTACGCTGGATCTAAGGAGAAGGGATCTGTTGAAAGCAATGGAAGTTCTACAGC
1231 T  F  P  L  R  A  *
3961 AACTTTTCCCCTTCGGGCATAAacacaacatatgtaagcaacgctactggttcaccccaa
4021 ccttccatatttatctgttcaaaggagcaagaactttcatataggaatagaaacatgctg
4081 gccgaagatttcatccagaagtcaacatcctgcaattatgttgaaaagagtagtactttc
4141 ttcaaaatataaaatgccaagcacttcaggcctatgttttgcttatattgttttcaggtg
4201 ctcaaaatgcaaaacacaaaacaaatcctgcatttagatacacctcaactaaatccaaag
4261 tccccattcagtatattccatatttgcctgattttactattcggtgtgtttgcatagatg
4321 ttgctacttggtgggtttttctccgtatgcacattggtatacagtctctgagaactggct
4381 tggtgactttgcttcactacaggttaaaagaccataagcaaactggttatttaaaatgta
4441 aaaaggaatatgaaagtcttattaaaacacttcattgaaaatatacagtctaaatttatt
4501 atttaaattttactagcaaaagtcttaggtgaacaatcaactagtatttgttgagctcct
4561 atttgcccagagatggtcatatttaaacagaagtatacgtttttcagtttcaacatgaat
4621 ttttttatttctgtcagttatgacatccacgagcatcactttttgtgtctgttttttttt
4681 ttttcttggactaaattcaactgcatggaagcggtggtcagaaggttgttttatacgaga
4741 acaggcagaaagtgcccattgttcaggattctaatagctacatctacttaatatcttcat
```

Fig. 2G-5

4801 ttctaaattgactgcttttaccttttctcatgtttatataatggtatgcttgcatatat
4861 ttcatgaatacattgtacatattatgttaatatttacacaatttaaaatatagatgtgtt
4921 ttattttgaagtgagaaaatgaacattaacaggcatgtttgtacagctagaatatattag
4981 taagatactgtttttcgtcattccagagctacaactaataacacgaggttccaaagctga
5041 agactttgtataaagtatttgggttttgttcttgtattgctttctttcaacagtttcaaa
5101 ataaaatatcatacaaatattgagggaaatgttttcatatttttcaaaataggtttttat
5161 tgttgaatgtacatctaccccagcccctcaaaagaaaaactgtttacatagaaattccta
5221 cacatacgtttgcgtatatgttattttaaacatctttgtggtgagaatttttccccgat
5281 attctccttctgtcaaagtcagaacaaattcagggaatttattttctggcagttgtgctc
5341 cagtccttttaaaattgtacatgaacatgttttagaaacaatatggaggatgatgcatac
5401 atgtcggtcaagttcagcgctcgacattttatggaaagatttttttaaccttaccacgaa
5461 atacttaactactgtttaagtgaattgacttatttcactttagtttttgaactgtgatta
5521 ttggtatactgttatatcctcaacttggatttatggtaaccccttttagttcatggagac
5581 caaaatttggggtatttataatagtcagcgcaggaatgcacatggaatatctacttgtcc
5641 ttttgaacctcacgagtcatccagaatgtatagacaggaaaagcatgtcttatttaaaac
5701 tgtaatttatgggctcaggatctgaccgcagtcccgggagtaagcatttcaaagggggaa
5761 ggcagtgtggtccctaccctgtgtgaatgtgaggatgtagacatccatcagtgcaactcg
5821 agctccatcctcctccgatttctaaggctccagttttctggagggacagtcatcatgttt
5881 tgatttatctgggagaaaactgtggtgcacagcttgtgaggagggcaaggttgtgacgtt
5941 cgagcttagttctggtgttattctgtctcctcttctttgtcatcagccaaaacgtggttt
6001 ttaaagagagtcatgcaggttagaaataatgtcaaaaatatttaggaatttaataacctt
6061 taagtcagaaactaaaacaaatactgaaatattagctcttcctacacttcgtgttcccct
6121 ttagctgcctgaaaatcaagattgctcctactcagatcttctgagtggctaaaacttatg
6181 gatatgaaaaatgagattgaatgatgactatgctttgctatcattgttacctttcctcaa
6241 tactatttggcaactactgggactcttcagcacaaaaggaatagatctatgattgaccct
6301 gattttaattgtgaaattatatgattcatatattttatgaatcagaataaccttcaaata
6361 aaataaatctaagtcggttaaaatggatttcatgattttccctcagaaaatgagtaacgg
6421 agtccacggcgtgcaatggtaattataaattggtgatgcttgtttgcaaattgcccactc
6481 gtgataagtcaacagccaatatttaaaactttgttcgttactggctttaccctaactttc
6541 tctagtctactgtcaatatcattttaatgtaattgattgtatatagtctcaagaatggtt
6601 ggtgggcatgagttcctagagaactgtccaagggttgggaaaatccaaattctcttcctg
6661 gctccagcactgattttgtacataaacattaggcaggttgcttaaccttttatttcaaa
6721 ctctctcaactctaaagtgctaataatactcagttaccttatctttgtcacagggtgt
6781 tctttttatgaagaaaaatttgaaaatgataaaagctaagatgccttctaacttcataa
6841 gcaaacctttaactaattatgtatctgaaagtcacccccacataccaactcaactttttt
6901 cctgtgaacacataaatatattttatagaaaaacaaatctacataaaataaatctactg
6961 tttagtgagcagtatgacttgtacatgccattgaaaattattaatcagaagaaaattaag
7021 cagggtctttgctatacaaaagtgttttccactaattttgcatgcgtatttataagaaaa
7081 atgtgaatttggtggttttattctatcggtataaaggcatcgatattttagatgcacccg
7141 tgtttgtaaaaatgtagagcacaatggaattatgctggaagtctcaaataatatttttt
7201 cctattttatactcatggaagagataagctaaagaggggacaataatgagaaatgttggt

Fig. 2G-6

```
7261 gtgcttttctaagcatttaaaacataattgccaattgaaaccctaaatatgtttacatac
7321 cattaagatatgattcatgtaacaatgttaaattaattataatgggattgggtttgttat
7381 ctgtggtagtatatatcctagtgttcctatagtgaaataagtagggttcagccaaagctt
7441 tctttgttttgtaccttaaattgttcgattacgtcatcaaaagagatgaaaggtatgtag
7501 aacaggttcacgtgattaccttttcttttggcttggattaatattcatagtagaacttt
7561 ataaaacgtgtttgtattgtaggtggtgtttgtattatgcttatgactatgtatggtttg
7621 aaaatattttcattatacatgaaattcaactttccaaataaaagttctacttcatgtaat
7681 ccaaaa
```

Fig. 2H-1. The cDNA (SEQ ID. NO.: 16) and amino acid sequence (SEQ ID. NO.: 17) of 282P1G3 v.8. The Kozak initiation sequence is shown in bold, and the start methionine is underlined. The open reading frame extends from nucleic acid 272-3859 including the stop codon.

```
   1 cggaccctgcgcgccccgtcccggctcccggccggctcgggggagaaggcgcccgaggg
  61 gaggcgccggacagatcgcgtttcggaggcggcgcaggtgctgtaaactgcaaaccataa
 121 tcctgtcttaatactgcaaacaaatcatagtggaactaaggggaacttaatttactgttt
 181 ccaggttaactaaggtctcagctgtaaaccaaaagtgagaggagacattaagattttcat
   1                                M  E  P  L  L  L  G  R  G  L
 241 tcttaccgggttgtcttcttcctgaagagcaATGGAGCCGCTTTTACTTGGAAGAGGACT
  11  I  V  Y  L  M  F  L  L  L  K  F  S  K  A  I  E  I  P  S  S
 301 AATCGTATATCTAATGTTCCTCCTGTTAAAATTCTCAAAAGCAATTGAAATACCATCTTC
  31  V  Q  Q  V  P  T  I  I  K  Q  S  K  V  Q  V  A  F  P  F  D
 361 AGTTCAACAGGTTCCAACAATCATAAAACAGTCAAAAGTCCAAGTTGCCTTTCCCTTCGA
  51  E  Y  F  Q  I  E  C  E  A  K  G  N  P  E  P  T  F  S  W  T
 421 TGAGTATTTTCAAATTGAATGTGAAGCTAAAGGAAATCCAGAACCAACATTTTCGTGGAC
  71  K  D  G  N  P  F  Y  F  T  D  H  R  I  I  P  S  N  N  S  G
 481 TAAGGATGGCAACCCTTTTTATTTCACTGACCATCGGATAATTCCATCGAACAATTCAGG
  91  T  F  R  I  P  N  E  G  H  I  S  H  F  Q  G  K  Y  R  C  F
 541 AACATTCAGGATCCCAAACGAGGGGCACATATCTCACTTTCAAGGGAAATACCGCTGCTT
 111  A  S  N  K  L  G  I  A  M  S  E  E  I  E  F  I  V  P  K  L
 601 TGCTTCAAATAAACTGGGAATCGCTATGTCAGAAGAAATAGAATTTATAGTTCCAAAATT
 131  E  H  I  E  Q  D  E  R  V  Y  M  S  Q  K  G  D  L  Y  F  A
 661 AGAACACATCGAACAAGATGAAAGAGTATACATGAGCCAAAAGGGAGATCTATACTTCGC
 151  N  V  E  E  K  D  S  R  N  D  Y  C  C  F  A  A  F  P  R  L
 721 AAACGTGGAAGAAAAGGACAGTCGCAATGACTACTGTTGCTTTGCTGCATTTCCAAGATT
 171  R  T  I  V  Q  K  M  P  M  K  L  T  V  N  S  L  K  H  A  N
 781 AAGGACTATTGTACAGAAAATGCCAATGAAACTAACAGTTAACAGTTTAAAGCATGCTAA
 191  D  S  S  S  S  T  E  I  G  S  K  A  N  S  I  K  Q  R  K  P
 841 TGACTCAAGTTCATCCACAGAAATTGGTTCCAAGGCAAATTCCATCAAGCAAAGAAAACC
 211  K  L  L  L  P  P  T  E  S  G  S  E  S  S  I  T  I  L  K  G
```

Fig. 2H-2

```
 901 CAAACTGCTGTTGCCTCCCACTGAGAGTGGCAGTGAGTCTTCAATTACCATCCTCAAAGG
 231  E  I  L  L  L  E  C  F  A  E  G  L  P  T  P  Q  V  D  W  N
 961 GGAAATCTTGCTGCTTGAGTGTTTTGCTGAAGGCTTGCCAACTCCACAGGTTGATTGGAA
 251  K  I  G  G  D  L  P  K  G  R  E  T  K  E  N  Y  G  K  T  L
1021 CAAAATTGGTGGTGACTTACCAAAGGGGAGAGAAACAAAAGAAAATTATGGCAAGACTTT
 271  K  I  E  N  V  S  Y  Q  D  K  G  N  Y  R  C  T  A  S  N  F
1081 GAAGATAGAGAATGTCTCCTACCAGGACAAAGGAAATTATCGCTGCACAGCCAGCAATTT
 291  L  G  T  A  T  H  D  F  H  V  I  V  E  D  N  I  S  H  E  L
1141 CTTGGGAACAGCCACTCACGATTTTCACGTTATAGTAGAAGATAACATCTCTCATGAGCT
 311  F  T  L  H  P  E  P  P  R  W  T  K  K  P  Q  S  A  V  Y  S
1201 CTTCACTTTACATCCAGAGCCTCCTCGCTGGACAAAGAAGCCTCAGAGTGCTGTGTATAG
 331  T  G  S  N  G  I  L  L  C  E  A  E  G  E  P  Q  P  T  I  K
1261 CACCGGAAGCAATGGCATCTTGTTATGTGAGGCTGAAGGAGAACCTCAACCCACAATCAA
 351  W  R  V  N  G  S  P  V  D  N  H  P  F  A  G  D  V  V  F  P
1321 GTGGAGAGTCAATGGCTCCCCAGTTGACAATCATCCATTTGCTGGTGATGTTGTCTTCCC
 371  R  E  I  S  F  T  N  L  Q  P  N  H  T  A  V  Y  Q  C  E  A
1381 CAGGGAAATCAGTTTTACCAACCTTCAACCAAATCATACTGCTGTGTACCAGTGTGAAGC
 391  S  N  V  H  G  T  I  L  A  N  A  N  I  D  V  V  D  V  R  P
1441 CTCAAATGTCCATGGAACTATCCTTGCCAATGCCAATATTGATGTTGTGGATGTCCGTCC
 411  L  I  Q  T  K  D  G  E  N  Y  A  T  V  V  G  Y  S  A  F  L
1501 ATTGATACAAACCAAAGATGGAGAAAATTACGCTACAGTGGTTGGGTACAGTGCTTTCTT
 431  H  C  E  F  F  A  S  P  E  A  V  V  S  W  Q  K  V  E  E  V
1561 ACATTGCGAGTTCTTTGCTTCACCTGAGGCAGTCGTGTCCTGGCAGAAGGTGGAAGAAGT
 451  K  P  L  E  G  R  R  Y  H  I  Y  E  N  G  T  L  Q  I  N  R
1621 GAAACCCCTGGAGGGCAGGCGGTATCATATCTATGAAAATGGCACATTGCAGATCAACAG
 471  T  T  E  E  D  A  G  S  Y  S  C  W  V  E  N  A  I  G  K  T
1681 AACCACCGAAGAAGATGCTGGGTCTTACTCATGTTGGGTAGAAAATGCTATAGGAAAAAC
 491  A  V  T  A  N  L  D  I  R  N  A  T  K  L  R  V  S  P  K  N
1741 TGCAGTCACAGCCAATTTGGATATTAGAAATGCTACAAAACTTAGAGTTTCTCCTAAGAA
 511  P  R  I  P  K  L  H  M  L  E  L  H  C  E  S  K  C  D  S  H
1801 TCCTCGTATCCCCAAATTGCATATGCTTGAATTACATTGTGAAAGCAAATGTGACTCACA
 531  L  K  H  S  L  K  L  S  W  S  K  D  G  E  A  F  E  I  N  G
1861 TTTGAAACACAGTTTGAAGTTGTCCTGGAGTAAAGATGGAGAAGCCTTTGAAATTAATGG
 551  T  E  D  G  R  I  I  I  D  G  A  N  L  T  I  S  N  V  T  L
1921 CACAGAAGATGGCAGGATAATTATTGATGGAGCTAATTTGACCATATCTAATGTAACTTT
 571  E  D  Q  G  I  Y  C  C  S  A  H  T  A  L  D  S  A  A  D  I
1981 AGAGGACCAAGGTATTTACTGCTGTTCAGCTCATACTGCTCTAGACAGTGCTGCCGATAT
 591  T  Q  V  T  V  L  D  V  P  D  P  P  E  N  L  H  L  S  E  R
2041 AACTCAAGTAACTGTTCTTGATGTTCCGGATCCACCAGAAAACCTTCACTTGTCTGAAAG
 611  Q  N  R  S  V  R  L  T  W  E  A  G  A  D  H  N  S  N  I  S
2101 ACAGAACAGGAGTGTTCGGCTGACCTGGGAAGCTGGAGCTGACCACAACAGCAATATTAG
```

Fig. 2H-3

```
631  E  Y  I  V  E  F  E  G  N  K  E  E  P  G  R  W  E  E  L  T
2161 CGAGTATATTGTTGAATTTGAAGGAAACAAAGAAGAGCCTGGAAGGTGGGAGGAACTGAC
651  R  V  Q  G  K  K  T  T  V  I  L  P  L  A  P  F  V  R  Y  Q
2221 CAGAGTCCAAGGAAAGAAAACCACAGTTATCTTACCTTTGGCTCCATTTGTGAGATACCA
671  F  R  V  I  A  V  N  E  V  G  R  S  Q  P  S  Q  P  S  D  H
2281 GTTCAGGGTCATAGCCGTGAACGAAGTAGGGAGAAGTCAGCCTAGCCAGCCGTCAGACCA
691  H  E  T  P  P  A  A  P  D  R  N  P  Q  N  I  R  V  Q  A  S
2341 TCATGAAACACCACCAGCAGCTCCAGATAGGAATCCACAAAACATAAGGGTTCAAGCCTC
711  Q  P  K  E  M  I  I  K  W  E  P  L  K  S  M  E  Q  N  G  P
2401 TCAACCCAAGGAAATGATTATAAAGTGGGAGCCTTTGAAATCCATGGAGCAGAATGGACC
731  G  L  E  Y  R  V  T  W  K  P  Q  G  A  P  V  E  W  E  E  E
2461 AGGCCTAGAGTACAGAGTGACCTGGAAGCCACAGGGAGCCCCAGTGGAGTGGGAAGAAGA
751  T  V  T  N  H  T  L  R  V  M  T  P  A  V  Y  A  P  Y  D  V
2521 AACAGTCACAAACCACACATTGCGGGTGATGACGCCTGCTGTCTATGCCCCTTATGATGT
771  K  V  Q  A  I  N  Q  L  G  S  G  P  D  P  Q  S  V  T  L  Y
2581 CAAGGTCCAGGCTATCAATCAACTAGGATCTGGGCCTGACCCTCAGTCAGTGACTCTCTA
791  S  G  E  D  Y  P  D  T  A  P  V  I  H  G  V  D  V  I  N  S
2641 TTCTGGAGAAGACTATCCTGATACAGCTCCAGTGATCCATGGGGTGGACGTTATAAACAG
811  T  L  V  K  V  T  W  S  T  V  P  K  D  R  V  H  G  R  L  K
2701 TACATTAGTTAAAGTTACCTGGTCAACAGTTCCAAAGGACAGAGTACATGGACGTCTGAA
831  G  Y  Q  I  N  W  W  K  T  K  S  L  L  D  G  R  T  H  P  K
2761 AGGCTATCAGATAAATTGGTGGAAAACAAAAAGTCTGTTGGATGGAAGAACACATCCCAA
851  E  V  N  I  L  R  F  S  G  Q  R  N  S  G  M  V  P  S  L  D
2821 AGAAGTGAACATTCTAAGATTTTCAGGACAAAGAAACTCTGGAATGGTTCCTTCCTTAGA
871  A  F  S  E  F  H  L  T  V  L  A  Y  N  S  K  G  A  G  P  E
2881 TGCCTTTAGTGAATTTCATTTAACAGTCTTAGCCTATAACTCTAAAGGAGCTGGTCCTGA
891  S  E  P  Y  I  F  Q  T  P  E  G  V  P  E  Q  P  T  F  L  K
2941 AAGTGAGCCTTATATATTTCAAACACCAGAAGGAGTACCTGAACAGCCAACTTTTCTAAA
911  V  I  K  V  D  K  D  T  A  T  L  S  W  G  L  P  K  K  L  N
3001 GGTCATCAAAGTTGATAAAGACACTGCCACTTTATCTTGGGGACTACCTAAGAAATTAAA
931  G  N  L  T  G  Y  L  L  Q  Y  Q  I  I  N  D  T  Y  E  I  G
3061 TGGAAACTTAACTGGCTATCTTTTGCAATATCAGATAATAAATGACACCTACGAGATTGG
951  E  L  N  D  I  N  I  T  T  P  S  K  P  S  W  H  L  S  N  L
3121 AGAATTAAATGATATTAACATTACAACTCCATCAAAGCCCAGCTGGCACCTCTCAAACCT
971  N  A  T  T  K  Y  K  F  Y  L  R  A  C  T  S  Q  G  C  G  K
3181 GAATGCAACTACCAAGTACAAATTCTACTTGAGGGCTTGCACTTCACAGGGCTGTGGAAA
991  P  I  T  E  E  S  S  T  L  G  E  G  S  K  G  I  G  K  I  S
3241 ACCGATCACGGAGGAAAGCTCCACCTTAGGAGAAGGGAGTAAAGGTATCGGGAAGATATC
1011 G  V  N  L  T  Q  K  T  H  P  I  E  V  F  E  P  G  A  E  H
3301 AGGAGTAAATCTTACTCAAAAGACTCACCCAATAGAGGTATTTGAGCCGGGAGCTGAACA
1031 I  V  R  L  M  T  K  N  W  G  D  N  D  S  I  F  Q  D  V  I
```

Fig. 2H-4

3361 TATAGTTCGCCTAATGACTAAGAATTGGGGCGATAACGATAGCATTTTTCAAGATGTAAT
1051 E T R G R E Y A G L Y D D I S T Q G W F
3421 TGAGACAAGAGGGAGAGAATATGCTGGTTTATATGATGACATCTCCACTCAAGGCTGGTT
1071 I G L M C A I A L L T L L L L T V C F V
3481 TATTGGACTGATGTGTGCGATTGCTCTTCTCACACTACTATTATTAACTGTTTGCTTTGT
1091 K R N R G G K Y S V K E K E D L H P D P
3541 GAAGAGGAATAGAGGTGGAAAGTACTCAGTTAAAGAAAAGGAAGATTTGCATCCAGACCC
1111 E I Q S V K D E T F G E Y S D S D E K P
3601 AGAAATTCAGTCAGTAAAAGATGAAACCTTTGGTGAATACAGTGACAGTGATGAAAAGCC
1131 L K G S L R S L N R D M Q P T E S A D S
3661 TCTCAAAGGAAGCCTTCGGTCCCTTAATAGGGATATGCAGCCTACTGAAAGTGCTGACAG
1151 L V E Y G E G D H G L F S E D G S F I G
3721 CTTAGTCGAATACGGAGAGGGAGACCATGGTCTCTTCAGTGAAGATGGATCATTTATTGG
1171 A Y A G S K E K G S V E S N G S S T A T
3781 TGCCTACGCTGGATCTAAGGAGAAGGGATCTGTTGAAAGCAATGGAAGTTCTACAGCAAC
1191 F P L R A *
3841 TTTTCCCCTTCGGGCATAAacacaacatatgtaagcaacgctactggttcaccccaacct
3901 tccatatttatctgttcaaaggagcaagaactttcatataggaatagaaacatgctggcc
3961 gaagatttcatccagaagtcaacatcctgcaattatgttgaaaagagtagtactttcttc
4021 aaaatataaaatgccaagcacttcaggcctatgttttgcttatattgttttcaggtgctc
4081 aaaatgcaaaacacaaaacaaatcctgcatttagatacacctcaactaaatccaaagtcc
4141 ccattcagtatattccatatttgcctgattttactattcggtgtgtttgcatagatgttg
4201 ctacttggtgggtttttctccgtatgcacattggtatacagtctctgagaactggcttgg
4261 tgactttgcttcactacaggttaaaagaccataagcaaactggttatttaaaatgtaaaa
4321 aggaatatgaaagtcttattaaaacacttcattgaaaatatacagtctaaatttattatt
4381 taaattttactagcaaaagtcttaggtgaacaatcaactagtatttgttgagctcctatt
4441 tgcccagagatggtcatatttaaacagaagtatacgtttttcagtttcaacatgaatttt
4501 tttatttctgtcagttatgacatccacgagcatcactttttgtgtctgtttttttttttt
4561 tcttggactaaattcaactgcatggaagcggtggtcagaaggttgttttatacgagaaca
4621 ggcagaaagtgcccattgttcaggattctaatagctacatctacttaatatcttcatttc
4681 taaattgactgcttttacctttttctcatgtttatataatggtatgcttgcatatatttc
4741 atgaatacattgtacatattatgttaatatttacacaatttaaaatatagatgtgtttta
4801 ttttgaagtgagaaaatgaacattaacaggcatgtttgtacagctagaatatattagtaa
4861 gatactgtttttcgtcattccagagctacaactaataacacgaggttccaaagctgaaga
4921 ctttgtataaagtatttgggttttgttcttgtattgctttctttcaacagtttcaaaata
4981 aaatatcatacaaatattgagggaaatgttttcatatttttcaaaataggtttttattgt
5041 tgaatgtacatctaccccagcccctcaaaagaaaaactgtttacatagaaattcctacac
5101 atacgtttgcgtatatgttattttaaacatctttgtggtgagaatttttccccgatatt
5161 ctccttctgtcaaagtcagaacaaattcagggaatttattttctggcagttgtgctccag
5221 tccttttaaaattgtacatgaacatgttttagaaacaatatggaggatgatgcatacatg
5281 tcggtcaagttcagcgctcgacattttatggaaagattttttaaccttaccacgaaata

Fig. 2H-5

5341 cttaactactgtttaagtgaattgacttatttcactttagtttttgaactgtgattattg
5401 gtatactgttatatcctcaacttggatttatggtaaccccttttagttcatggagaccaa
5461 aatttggggtatttataatagtcagcgcaggaatgcacatggaatatctacttgtccttt
5521 tgaacctcacgagtcatccagaatgtatagacaggaaaagcatgtcttatttaaaactgt
5581 aatttatgggctcaggatctgaccgcagtcccgggagtaagcatttcaaaggggggaaggc
5641 agtgtggtccctaccctgtgtgaatgtgaggatgtagacatccatcagtgcaactcgagc
5701 tccatcctcctccgatttctaaggctccagttttctggagggacagtcatcatgttttga
5761 tttatctgggagaaaactgtggtgcacagcttgtgaggagggcaaggttgtgacgttcga
5821 gcttagttctggtgttattctgtctcctcttctttgtcatcagccaaaacgtggttttta
5881 aagagagtcatgcaggttagaaataatgtcaaaaatatttaggaatttaataacctttaa
5941 gtcagaaactaaaacaaatactgaaatattagctcttcctacacttcgtgttccccttta
6001 gctgcctgaaaatcaagattgctcctactcagatcttctgagtggctaaaacttatggat
6061 atgaaaaatgagattgaatgatgactatgctttgctatcattgttacctttcctcaatac
6121 tatttggcaactactgggactcttcagcacaaaaggaatagatctatgattgaccctgat
6181 tttaattgtgaaattatatgattcatatattttatgaatcagaataaccttcaaataaaa
6241 taaatctaagtcggttaaaatggatttcatgattttccctcagaaaatgagtaacggagt
6301 ccacggcgtgcaatggtaattataaattggtgatgcttgtttgcaaattgcccactcgtg
6361 ataagtcaacagccaatatttaaaactttgttcgttactggctttaccctaactttctct
6421 agtctactgtcaatatcattttaatgtaattgattgtatatagtctcaagaatggttggt
6481 gggcatgagttcctagagaactgtccaagggttgggaaaatccaaattctcttcctggct
6541 ccagcactgattttgtacataaacattaggcaggttgcttaacctttttatttcaaactc
6601 tctcaactctaaagtgctaataataatctcagttaccttatctttgtcacagggtgttct
6661 tttttatgaagaaaaatttgaaaatgataaaagctaagatgccttctaacttcataagca
6721 aacctttaactaattatgtatctgaaagtcacccccacataccaactcaactttttttcct
6781 gtgaacacataaatatattttatagaaaaacaaatctacataaaataaatctactgttt
6841 agtgagcagtatgacttgtacatgccattgaaaattattaatcagaagaaaattaagcag
6901 ggtctttgctatacaaaagtgttttccactaattttgcatgcgtatttataagaaaaatg
6961 tgaatttggtggttttattctatcggtataaaggcatcgatattttagatgcacccgtgt
7021 ttgtaaaaatgtagagcacaatggaattatgctggaagtctcaaataatatttttttcct
7081 attttatactcatggaagagataagctaaagaggggacaataatgagaaatgttggtgtg
7141 cttttctaagcatttaaaacataattgccaattgaaaccctaaatatgtttacataccat
7201 taagatatgattcatgtaacaatgttaaattaattataatgggattgggtttgttatctg
7261 tggtagtatatatcctagtgttcctatagtgaaataagtagggttcagccaaagctttct
7321 ttgttttgtaccttaaattgttcgattacgtcatcaaaagagatgaaaggtatgtagaac
7381 aggttcacgtgattaccttttttcttttggcttggattaatattcatagtagaactttata
7441 aaacgtgtttgtattgtaggtggtgtttgtattatgcttatgactatgtatggtttgaaa
7501 atattttcattatacatgaaattcaactttccaaataaaagttctacttcatgtaatcca
7561 aaa Fig. 2I-1. The cDNA (SEQ ID. NO.: 18) and amino acid sequence (SEQ ID. NO.: 19) of 282P1G3 v.28. The Kozak initiation sequence is shown in bold, and the start methionine is underlined. The open reading frame extends from nucleic acid 192-3866 including the stop codon.

```
   1 cggaccctgcgcgcccccgtcccggctcccggccggctcgggggagaaggcgcccgaggg
  61 gaggcgccggacagatcgcgtttcggaggcggcgcagtttccaggttaactaaggtctca
 121 gctgtaaaccaaaagtgagaggagacattaagattttcattcttaccgggttgtcttctt
   1            M  E  P  L  L  L  G  R  G  L  I  V  Y  L  M  F  L
 181 cctgaagagcaATGGAGCCGCTTTTACTTGGAAGAGGACTAATCGTATATCTAATGTTCC
  18  L  L  K  F  S  K  A  I  E  I  P  S  S  V  Q  Q  V  P  T  I
 241 TCCTGTTAAAATTCTCAAAAGCAATTGAAATACCATCTTCAGTTCAACAGGTTCCAACAA
  38  I  K  Q  S  K  V  Q  V  A  F  P  F  D  E  Y  F  Q  I  E  C
 301 TCATAAAACAGTCAAAAGTCCAAGTTGCCTTTCCCTTCGATGAGTATTTTCAAATTGAAT
  58  E  A  K  G  N  P  E  P  T  F  S  W  T  K  D  G  N  P  F  Y
 361 GTGAAGCTAAAGGAAATCCAGAACCAACATTTTCGTGGACTAAGGATGGCAACCCTTTTT
  78  F  T  D  H  R  I  I  P  S  N  N  S  G  T  F  R  I  P  N  E
 421 ATTTCACTGACCATCGGATAATTCCATCGAACAATTCAGGAACATTCAGGATCCCAAACG
  98  G  H  I  S  H  F  Q  G  K  Y  R  C  F  A  S  N  K  L  G  I
 481 AGGGGCACATATCTCACTTTCAAGGGAAATACCGCTGCTTTGCTTCAAATAAACTGGGAA
 118  A  M  S  E  E  I  E  F  I  V  P  S  V  P  K  L  P  K  E  K
 541 TCGCTATGTCAGAAGAAATAGAATTTATAGTTCCAAGTGTTCCAAAACTCCCAAAAGAAA
 138  I  D  P  L  E  V  E  E  G  D  P  I  V  L  P  C  N  P  P  K
 601 AAATTGACCCTCTTGAAGTGGAGGAGGGAGATCCAATTGTCCTCCCATGCAATCCTCCCA
 158  G  L  P  P  L  H  I  Y  W  M  N  I  E  L  E  H  I  E  Q  D
 661 AAGGCCTCCCACCTTTACACATTTATTGGATGAATATTGAATTAGAACACATCGAACAAG
 178  E  R  V  Y  M  S  Q  K  G  D  L  Y  F  A  N  V  E  E  K  D
 721 ATGAAAGAGTATACATGAGCCAAAAGGGAGATCTATACTTCGCAAACGTGGAAGAAAAGG
 198  S  R  N  D  Y  C  C  F  A  A  F  P  R  L  R  T  I  V  Q  K
 781 ACAGTCGCAATGACTACTGTTGCTTTGCTGCATTTCCAAGATTAAGGACTATTGTACAGA
 218  M  P  M  K  L  T  V  N  S  L  K  H  A  N  D  S  S  S  S  T
 841 AAATGCCAATGAAACTAACAGTTAACAGTTTAAAGCATGCTAATGACTCAAGTTCATCCA
 238  E  I  G  S  K  A  N  S  I  K  Q  R  K  P  K  L  L  L  P  P
 901 CAGAAATTGGTTCCAAGGCAAATTCCATCAAGCAAAGAAAACCCAAACTGCTGTTGCCTC
 258  T  E  S  G  S  E  S  S  I  T  I  L  K  G  E  I  L  L  L  E
 961 CCACTGAGAGTGGCAGTGAGTCTTCAATTACCATCCTCAAAGGGGAAATCTTGCTGCTTG
 278  C  F  A  E  G  L  P  T  P  Q  V  D  W  N  K  I  G  G  D  L
1021 AGTGTTTTGCTGAAGGCTTGCCAACTCCACAGGTTGATTGGAACAAAATTGGTGGTGACT
 298  P  K  G  R  E  T  K  E  N  Y  G  K  T  L  K  I  E  N  V  S
1081 TACCAAAGGGGAGAGAAACAAAAGAAAATTATGGCAAGACTTTGAAGATAGAGAATGTCT
 318  Y  Q  D  K  G  N  Y  R  C  T  A  S  N  F  L  G  T  A  T  H
1141 CCTACCAGGACAAAGGAAATTATCGCTGCACAGCCAGCAATTTCTTGGGAACAGCCACTC
 338  D  F  H  V  I  V  E  E  P  P  R  W  T  K  K  P  Q  S  A  V
```

Fig. 21-2

```
1201 ACGATTTTCACGTTATAGTAGAAGAGCCTCCTCGCTGGACAAAGAAGCCTCAGAGTGCTG
 358   Y  S  T  G  S  N  G  I  L  L  C  E  A  E  G  E  P  Q  P  T
1261 TGTATAGCACCGGAAGCAATGGCATCTTGTTATGTGAGGCTGAAGGAGAACCTCAACCCA
 378   I  K  W  R  V  N  G  S  P  V  D  N  H  P  F  A  G  D  V  V
1321 CAATCAAGTGGAGAGTCAATGGCTCCCCAGTTGACAATCATCCATTTGCTGGTGATGTTG
 398   F  P  R  E  I  S  F  T  N  L  Q  P  N  H  T  A  V  Y  Q  C
1381 TCTTCCCCAGGGAAATCAGTTTTACCAACCTTCAACCAAATCATACTGCTGTGTACCAGT
 418   E  A  S  N  V  H  G  T  I  L  A  N  A  N  I  D  V  V  D  V
1441 GTGAAGCCTCAAATGTCCATGGAACTATCCTTGCCAATGCCAATATTGATGTTGTGGATG
 438   R  P  L  I  Q  T  K  D  G  E  N  Y  A  T  V  V  G  Y  S  A
1501 TCCGTCCATTGATACAAACCAAAGATGGAGAAAATTACGCTACAGTGGTTGGGTACAGTG
 458   F  L  H  C  E  F  F  A  S  P  E  A  V  V  S  W  Q  K  V  E
1561 CTTTCTTACATTGCGAGTTCTTTGCTTCACCTGAGGCAGTCGTGTCCTGGCAGAAGGTGG
 478   E  V  K  P  L  E  G  R  R  Y  H  I  Y  E  N  G  T  L  Q  I
1621 AAGAAGTGAAACCCCTGGAGGGCAGGCGGTATCATATCTATGAAAATGGCACATTGCAGA
 498   N  R  T  T  E  E  D  A  G  S  Y  S  C  W  V  E  N  A  I  G
1681 TCAACAGAACCACCGAAGAAGATGCTGGGTCTTACTCATGTTGGGTAGAAAATGCTATAG
 518   K  T  A  V  T  A  N  L  D  I  R  N  A  T  K  L  R  V  S  P
1741 GAAAAACTGCAGTCACAGCCAATTTGGATATTAGAAATGCTACAAAACTTAGAGTTTCTC
 538   K  N  P  R  I  P  K  L  H  M  L  E  L  H  C  E  S  K  C  D
1801 CTAAGAATCCTCGTATCCCCAAATTGCATATGCTTGAATTACATTGTGAAAGCAAATGTG
 558   S  H  L  K  H  S  L  K  L  S  W  S  K  D  G  E  A  F  E  I
1861 ACTCACATTTGAAACACAGTTTGAAGTTGTCCTGGAGTAAAGATGGAGAAGCCTTTGAAA
 578   N  G  T  E  D  G  R  I  I  I  D  G  A  N  L  T  I  S  N  V
1921 TTAATGGCACAGAAGATGGCAGGATAATTATTGATGGAGCTAATTTGACCATATCTAATG
 598   T  L  E  D  Q  G  I  Y  C  C  S  A  H  T  A  L  D  S  A  A
1981 TAACTTTAGAGGACCAAGGTATTTACTGCTGTTCAGCTCATACTGCTCTAGACAGTGCTG
 618   D  I  T  Q  V  T  V  L  D  V  P  D  P  P  E  N  L  H  L  S
2041 CCGATATAACTCAAGTAACTGTTCTTGATGTTCCGGATCCACCAGAAAACCTTCACTTGT
 638   E  R  Q  N  R  S  V  R  L  T  W  E  A  G  A  D  H  N  S  N
2101 CTGAAAGACAGAACAGGAGTGTTCGGCTGACCTGGGAAGCTGGAGCTGACCACAACAGCA
 658   I  S  E  Y  I  V  E  F  E  G  N  K  E  E  P  G  R  W  E  E
2161 ATATTAGCGAGTATATTGTTGAATTTGAAGGAAACAAAGAAGAGCCTGGAAGGTGGGAGG
 678   L  T  R  V  Q  G  K  K  T  T  V  I  L  P  L  A  P  F  V  R
2221 AACTGACCAGAGTCCAAGGAAAGAAAACCACAGTTATCTTACCTTTGGCTCCATTTGTGA
 698   Y  Q  F  R  V  I  A  V  N  E  V  G  R  S  Q  P  S  Q  P  S
2281 GATACCAGTTCAGGGTCATAGCCGTGAACGAAGTAGGGAGAAGTCAGCCTAGCCAGCCGT
 718   D  H  H  E  T  P  P  A  A  P  D  R  N  P  Q  N  I  R  V  Q
2341 CAGACCATCATGAAACACCACCAGCAGCTCCAGATAGGAATCCACAAAACATAAGGGTTC
 738   A  S  Q  P  K  E  M  I  I  K  W  E  P  L  K  S  M  E  Q  N
2401 AAGCCTCTCAACCCAAGGAAATGATTATAAAGTGGGAGCCTTTGAAATCCATGGAGCAGA
```

Fig. 2I-3

```
758   G  P  G  L  E  Y  R  V  T  W  K  P  Q  G  A  P  V  E  W  E
2461 ATGGACCAGGCCTAGAGTACAGAGTGACCTGGAAGCCACAGGGAGCCCCAGTGGAGTGGG
778   E  E  T  V  T  N  H  T  L  R  V  M  T  P  A  V  Y  A  P  Y
2521 AAGAAGAAACAGTCACAAACCACACATTGCGGGTGATGACGCCTGCTGTCTATGCCCCTT
798   D  V  K  V  Q  A  I  N  Q  L  G  S  G  P  D  P  Q  S  V  T
2581 ATGATGTCAAGGTCCAGGCTATCAATCAACTAGGATCTGGGCCTGACCCTCAGTCAGTGA
818   L  Y  S  G  E  D  Y  P  D  T  A  P  V  I  H  G  V  D  V  I
2641 CTCTCTATTCTGGAGAAGACTATCCTGATACAGCTCCAGTGATCCATGGGGTGGACGTTA
838   N  S  T  L  V  K  V  T  W  S  T  V  P  K  D  R  V  H  G  R
2701 TAAACAGTACATTAGTTAAAGTTACCTGGTCAACAGTTCCAAAGGACAGAGTACATGGAC
858   L  K  G  Y  Q  I  N  W  W  K  T  K  S  L  L  D  G  R  T  H
2761 GTCTGAAAGGCTATCAGATAAATTGGTGGAAAACAAAAAGTCTGTTGGATGGAAGAACAC
878   P  K  E  V  N  I  L  R  F  S  G  Q  R  N  S  G  M  V  P  S
2821 ATCCCAAAGAAGTGAACATTCTAAGATTTTCAGGACAAAGAAACTCTGGAATGGTTCCTT
898   L  D  A  F  S  E  F  H  L  T  V  L  A  Y  N  S  K  G  A  G
2881 CCTTAGATGCCTTTAGTGAATTTCATTTAACAGTCTTAGCCTATAACTCTAAAGGAGCTG
918   P  E  S  E  P  Y  I  F  Q  T  P  E  G  V  P  E  Q  P  T  F
2941 GTCCTGAAAGTGAGCCTTATATATTTCAAACACCAGAAGGAGTACCTGAACAGCCAACTT
938   L  K  V  I  K  V  D  K  D  T  A  T  L  S  W  G  L  P  K  K
3001 TTCTAAAGGTCATCAAAGTTGATAAAGACACTGCCACTTTATCTTGGGGACTACCTAAGA
958   L  N  G  N  L  T  G  Y  L  L  Q  Y  Q  I  I  N  D  T  Y  E
3061 AATTAAATGGAAACTTAACTGGCTATCTTTTGCAATATCAGATAATAAATGACACCTACG
978   I  G  E  L  N  D  I  N  I  T  T  P  S  K  P  S  W  H  L  S
3121 AGATTGGAGAATTAAATGATATTAACATTACAACTCCATCAAAGCCCAGCTGGCACCTCT
998   N  L  N  A  T  T  K  Y  K  F  Y  L  R  A  C  T  S  Q  G  C
3181 CAAACCTGAATGCAACTACCAAGTACAAATTCTACTTGAGGGCTTGCACTTCACAGGGCT
1018  G  K  P  I  T  E  E  S  S  T  L  G  E  G  S  K  G  I  G  K
3241 GTGGAAAACCGATCACGGAGGAAAGCTCCACCTTAGGAGAAGGGAGTAAAGGTATCGGGA
1038  I  S  G  V  N  L  T  Q  K  T  H  P  I  E  V  F  E  P  G  A
3301 AGATATCAGGAGTAAATCTTACTCAAAAGACTCACCCAATAGAGGTATTTGAGCCGGGAG
1058  E  H  I  V  R  L  M  T  K  N  W  G  D  N  D  S  I  F  Q  D
3361 CTGAACATATAGTTCGCCTAATGACTAAGAATTGGGGCGATAACGATAGCATTTTTCAAG
1078  V  I  E  T  R  G  R  E  Y  A  G  L  Y  D  D  I  S  T  Q  G
3421 ATGTAATTGAGACAAGAGGGAGAGAATATGCTGGTTTATATGATGACATCTCCACTCAAG
1098  W  F  I  G  L  M  C  A  I  A  L  L  T  L  L  L  L  T  V  C
3481 GCTGGTTTATTGGACTGATGTGTGCGATTGCTCTTCTCACACTACTATTATTAACTGTTT
1118  F  V  K  R  N  R  G  G  K  Y  S  V  K  E  K  E  D  L  H  P
3541 GCTTTGTGAAGAGGAATAGAGGTGGAAAGTACTCAGTTAAAGAAAAGGAAGATTTGCATC
1138  D  P  E  I  Q  S  V  K  D  E  T  F  G  E  Y  S  D  S  D  E
3601 CAGACCCAGAAATTCAGTCAGTAAAAGATGAAACCTTTGGTGAATACAGTGACAGTGATG
1158  K  P  L  K  G  S  L  R  S  L  N  R  D  M  Q  P  T  E  S  A
```

Fig. 2I-4

```
3661 AAAAGCCTCTCAAAGGAAGCCTTCGGTCCCTTAATAGGGATATGCAGCCTACTGAAAGTG
1178   D  S  L  V  E  Y  G  E  G  D  H  G  L  F  S  E  D  G  S  F
3721 CTGACAGCTTAGTCGAATACGGAGAGGGAGACCATGGTCTCTTCAGTGAAGATGGATCAT
1198   I  G  A  Y  A  G  S  K  E  K  G  S  V  E  S  N  G  S  S  T
3781 TTATTGGTGCCTACGCTGGATCTAAGGAGAAGGGATCTGTTGAAAGCAATGGAAGTTCTA
1218   A  T  F  P  L  R  A  *
3841 CAGCAACTTTTCCCCTTCGGGCATAAacacaacatatgtaagcaacgctactggttcacc
3901 ccaaccttccatatttatctgttcaaaggagcaagaactttcatataggaatagaaacat
3961 gctggccgaagatttcatccagaagtcaacatcctgcaattatgttgaaaagagtagtac
4021 tttcttcaaaatataaaatgccaagcacttcaggcctatgttttgcttatattgttttca
4081 ggtgctcaaaatgcaaaacacaaaacaaatcctgcatttagatacacctcaactaaatcc
4141 aaagtccccattcagtatattccatatttgcctgattttactattcggtgtgtttgcata
4201 gatgttgctacttggtgggtttttctccgtatgcacattggtatacagtctctgagaact
4261 ggcttggtgactttgcttcactacaggttaaaagaccataagcaaactggttatttaaaa
4321 tgtaaaaaggaatatgaaagtcttattaaaacacttcattgaaaatatacagtctaaatt
4381 tattatttaaattttactagcaaaagtcttaggtgaacaatcaactagtatttgttgagc
4441 tcctatttgcccagagatggtcatatttaaacagaagtatacgtttttcagtttcaacat
4501 gaatttttttatttctgtcagttatgacatccacgagcatcacttttgtgtctgttttt
4561 tttttttcttggactaaattcaactgcatggaagcggtggtcagaaggttgttttatac
4621 gagaacaggcagaaagtgcccattgttcaggattctaatagctacatctacttaatatct
4681 tcatttctaaattgactgcttttaccttttttctcatgtttatataatggtatgcttgcat
4741 atatttcatgaatacattgtacatattatgttaatatttacacaatttaaaatatagatg
4801 tgttttattttgaagtgagaaaatgaacattaacaggcatgtttgtacagctagaatata
4861 ttagtaagatactgtttttcgtcattccagagctacaactaataacacgaggttccaaag
4921 ctgaagactttgtataaagtatttgggttttgttcttgtattgctttctttcaacagttt
4981 caaaataaaatatcatacaaatattgagggaaatgttttcatatttttcaaaataggttt
5041 ttattgttgaatgtacatctaccccagcccctcaaaagaaaaactgtttacatagaaatt
5101 cctacacatacgtttgcgtatatgttattttaaacatctttgtggtgagaatttttccc
5161 cgatattctccttctgtcaaagtcagaacaaattcagggaatttattttctggcagttgt
5221 gctccagtccttttaaaattgtacatgaacatgtttagaaacaatatggaggatgatgc
5281 atacatgtcggtcaagttcagcgctcgacattttatggaaagatttttttaaccttacca
5341 cgaaatacttaactactgtttaagtgaattgacttatttcactttagtttttgaactgtg
5401 attattggtatactgttatatcctcaacttggatttatggtaacccctttttagttcatgg
5461 agaccaaaatttggggtatttataatagtcagcgcaggaatgcacatggaatatctactt
5521 gtccttttgaacctcacgagtcatccagaatgtatagacaggaaaagcatgtcttattta
5581 aaactgtaatttatgggctcaggatctgaccgcagtcccgggagtaagcatttcaaaggg
5641 ggaaggcagtgtggtccctaccctgtgtgaatgtgaggatgtagacatccatcagtgcaa
5701 ctcgagctccatcctcctccgatttctaaggctccagttttctggagggacagtcatcat
5761 gttttgatttatctgggagaaaactgtggtgcacagcttgtgaggagggcaaggttgtga
5821 cgttcgagcttagttctggtgttattctgtctcctcttctttgtcatcagccaaaacgtg
5881 gtttttaaagagagtcatgcaggttagaaataatgtcaaaaatatttaggaatttaataa
```

Fig. 2I-5

```
5941 cctttaagtcagaaactaaaacaaatactgaaatattagctcttcctacacttcgtgttc
6001 ccctttagctgcctgaaaatcaagattgctcctactcagatcttctgagtggctaaaact
6061 tatggatatgaaaaatgagattgaatgatgactatgctttgctatcattgttacctttcc
6121 tcaatactatttggcaactactgggactcttcagcacaaaaggaatagatctatgattga
6181 ccctgattttaattgtgaaattatatgattcatatattttatgaatcagaataaccttca
6241 aataaaataaatctaagtcggttaaaatggatttcatgattttccctcagaaaatgagta
6301 acggagtccacggcgtgcaatggtaattataaattggtgatgcttgtttgcaaattgccc
6361 actcgtgataagtcaacagccaatatttaaaactttgttcgttactggctttaccctaac
6421 tttctctagtctactgtcaatatcattttaatgtaattgattgtatatagtctcaagaat
6481 ggttggtgggcatgagttcctagagaactgtccaagggttgggaaaatccaaattctctt
6541 cctggctccagcactgattttgtacataaacattaggcaggttgcttaaccttttattt
6601 caaactctctcaactctaaagtgctaataataatctcagttaccttatctttgtcacagg
6661 gtgttctttttatgaagaaaaatttgaaaatgataaaagctaagatgccttctaacttc
6721 ataagcaaacctttaactaattatgtatctgaaagtcacccccacataccaactcaactt
6781 ttttcctgtgaacacataaatatatttttatagaaaaacaaatctacataaaataaatct
6841 actgtttagtgagcagtatgacttgtacatgccattgaaaattattaatcagaagaaaat
6901 taagcagggtctttgctatacaaaagtgttttccactaattttgcatgcgtatttataag
6961 aaaaatgtgaatttggtggttttattctatcggtataaaggcatcgatattttagatgca
7021 cccgtgtttgtaaaaatgtagagcacaatggaattatgctggaagtctcaaataatattt
7081 ttttcctattttatactcatggaagagataagctaaagaggggacaataatgagaaatgt
7141 tggtgtgcttttctaagcatttaaaacataattgccaattgaaaccctaaatatgtttac
7201 ataccattaagatatgattcatgtaacaatgttaaattaattataatgggattgggtttg
7261 ttatctgtggtagtatatatcctagtgttcctatagtgaaataagtagggttcagccaaa
7321 gctttctttgttttgtaccttaaattgttcgattacgtcatcaaaagagatgaaaggtat
7381 gtagaacaggttcacgtgattaccttttcttttggcttggattaatattcatagtagaa
7441 ctttataaaacgtgtttgtattgtaggtggtgtttgtattatgcttatgactatgtatgg
7501 tttgaaaatattttcattatacatgaaattcaactttccaaataaaagttctacttcatg
7561 taatccaaaa
```

Fig. 2J-1. The cDNA (SEQ ID. NO.: 207) and amino acid sequence (SEQ ID. NO.: 208) of 282P1G3 v.14. The Kozak initiation sequence is shown in bold, and the start methionine is underlined. The open reading frame extends from nucleic acid 272-3946 including the stop codon.

```
  1 cggaccctgcgcgccccgtcccggctcccggccggctcgggggagaaggcgcccgaggg
 61 gaggcgccggacagatcgcgtttcggaggcggcgcaggtgctgtaaactgcaaaccataa
121 tcctgtcttaatactgcaaacaaatcatagtggaactaaggggaacttaatttactgttt
181 ccaggttaactaaggtctcagctgtaaaccaaaagtgagaggagacattaagattttcat
  1                               M  E  P  L  L  L  G  R  G  L
241 tcttaccgggttgtcttcttcctgaagagcaATGGAGCCGCTTTTACTTGGAAGAGGACT
 11  I  V  Y  L  M  F  L  L  L  K  F  S  K  A  I  E  I  P  S  S
301 AATCGTATATCTAATGTTCCTCCTGTTAAAATTCTCAAAAGCAATTGAAATACCATCTTC
```

Fig. 2J-2

```
  31 V  Q  Q  V  P  T  I  I  K  Q  S  K  V  Q  V  A  F  P  F  D
 361 AGTTCAACAGGTTCCAACAATCATAAAACAGTCAAAAGTCCAAGTTGCCTTTCCCTTCGA
  51 E  Y  F  Q  I  E  C  E  A  K  G  N  P  E  P  T  F  S  W  T
 421 TGAGTATTTTCAAATTGAATGTGAAGCTAAAGGAAATCCAGAACCAACATTTTCGTGGAC
  71 K  D  G  N  P  F  Y  F  T  D  H  R  I  I  P  S  N  N  S  G
 481 TAAGGATGGCAACCCTTTTTATTTCACTGACCATCGGATAATTCCATCGAACAATTCAGG
  91 T  F  R  I  P  N  E  G  H  I  S  H  F  Q  G  K  Y  R  C  F
 541 AACATTCAGGATCCCAAACGAGGGGCACATATCTCACTTTCAAGGGAAATACCGCTGCTT
 111 A  S  N  K  L  G  I  A  M  S  E  E  I  E  F  I  V  P  S  V
 601 TGCTTCAAATAAACTGGGAATCGCTATGTCAGAAGAAATAGAATTTATAGTTCCAAGTGT
 131 P  K  L  P  K  E  K  I  D  P  L  E  V  E  E  G  D  P  I  V
 661 TCCAAAACTCCCAAAAGAAAAAATTGACCCTCTTGAAGTGGAGGAGGGAGATCCAATTGT
 151 L  P  C  N  P  P  K  G  L  P  P  L  H  I  Y  W  M  N  I  E
 721 CCTCCCATGCAATCCTCCCAAAGGCCTCCCACCTTTACACATTTATTGGATGAATATTGA
 171 L  E  H  I  E  Q  D  E  R  V  Y  M  S  Q  K  G  D  L  Y  F
 781 ATTAGAACACATCGAACAAGATGAAAGAGTATACATGAGCCAAAAGGGAGATCTATACTT
 191 A  N  V  E  E  K  D  S  R  N  D  Y  C  C  F  A  A  F  P  R
 841 CGCAAACGTGGAAGAAAAGGACAGTCGCAATGACTACTGTTGCTTTGCTGCATTTCCAAG
 211 L  R  T  I  V  Q  K  M  P  M  K  L  T  V  N  S  L  K  H  A
 901 ATTAAGGACTATTGTACAGAAAATGCCAATGAAACTAACAGTTAACAGTTTAAAGCATGC
 231 N  D  S  S  S  S  T  E  I  G  S  K  A  N  S  I  K  Q  R  K
 961 TAATGACTCAAGTTCATCCACAGAAATTGGTTCCAAGGCAAATTCCATCAAGCAAAGAAA
 251 P  K  L  L  L  P  P  T  E  S  G  S  E  S  S  I  T  I  L  K
1021 ACCCAAACTGCTGTTGCCTCCCACTGAGAGTGGCAGTGAGTCTTCAATTACCATCCTCAA
 271 G  E  I  L  L  L  E  C  F  A  E  G  L  P  T  P  Q  V  D  W
1081 AGGGGAAATCTTGCTGCTTGAGTGTTTTGCTGAAGGCTTGCCAACTCCACAGGTTGATTG
 291 N  K  I  G  G  D  L  P  K  G  R  E  T  K  E  N  Y  G  K  T
1141 GAACAAAATTGGTGGTGACTTACCAAAGGGGAGAGAAACAAAAGAAAATTATGGCAAGAC
 311 L  K  I  E  N  V  S  Y  Q  D  K  G  N  Y  R  C  T  A  S  N
1201 TTTGAAGATAGAGAATGTCTCCTACCAGGACAAAGGAAATTATCGCTGCACAGCCAGCAA
 331 F  L  G  T  A  T  H  D  F  H  V  I  V  E  E  P  P  R  W  T
1261 TTTCTTGGGAACAGCCACTCACGATTTTCACGTTATAGTAGAAGAGCCTCCTCGCTGGAC
 351 K  K  P  Q  S  A  V  Y  S  T  G  S  N  G  I  L  L  C  E  A
1321 AAAGAAGCCTCAGAGTGCTGTGTATAGCACCGGAAGCAATGGCATCTTGTTATGTGAGGC
 371 E  G  E  P  Q  P  T  I  K  W  R  V  N  G  S  P  V  D  N  H
1381 TGAAGGAGAACCTCAACCCACAATCAAGTGGAGAGTCAATGGCTCCCCAGTTGACAATCA
 391 P  F  A  G  D  V  V  F  P  R  E  I  S  F  T  N  L  Q  P  N
1441 TCCATTTGCTGGTGATGTTGTCTTCCCCAGGGAAATCAGTTTTACCAACCTTCAACCAAA
 411 H  T  A  V  Y  Q  C  E  A  S  N  V  H  G  T  I  L  A  N  A
1501 TCATACTGCTGTGTACCAGTGTGAAGCCTCAAATGTCCATGGAACTATCCTTGCCAATGC
 431 N  I  D  V  V  D  V  R  P  L  I  Q  T  K  D  G  E  N  Y  A
```

Fig. 2J-3

```
1561 CAATATTGATGTTGTGGATGTCCGTCCATTGATACAAACCAAAGATGGAGAAAATTACGC
 451  T  V  V  G  Y  S  A  F  L  H  C  E  F  F  A  S  P  E  A  V
1621 TACAGTGGTTGGGTACAGTGCTTTCTTACATTGCGAGTTCTTTGCTTCACCTGAGGCAGT
 471  V  S  W  Q  K  V  E  E  V  K  P  L  E  G  R  R  Y  H  I  Y
1681 CGTGTCCTGGCAGAAGGTGGAAGAAGTGAAACCCCTGGAGGGCAGGCGGTATCATATCTA
 491  E  N  G  T  L  Q  I  N  R  T  T  E  E  D  A  G  S  Y  S  C
1741 TGAAAATGGCACATTGCAGATCAACAGAACCACCGAAGAAGATGCTGGGTCTTACTCATG
 511  W  V  E  N  A  I  G  K  T  A  V  T  A  N  L  D  I  R  N  A
1801 TTGGGTAGAAAATGCTATAGGAAAAACTGCAGTCACAGCCAATTTGGATATTAGAAATGC
 531  T  K  L  R  V  S  P  K  N  P  R  I  P  K  L  H  M  L  E  L
1861 TACAAAACTTAGAGTTTCTCCTAAGAATCCTCGTATCCCCAAATTGCATATGCTTGAATT
 551  H  C  E  S  K  C  D  S  H  L  K  H  S  L  K  L  S  W  S  K
1921 ACATTGTGAAAGCAAATGTGACTCACATTTGAAACACAGTTTGAAGTTGTCCTGGAGTAA
 571  D  G  E  A  F  E  I  N  G  T  E  D  G  R  I  I  I  D  G  A
1981 AGATGGAGAAGCCTTTGAAATTAATGGCACAGAAGATGGCAGGATAATTATTGATGGAGC
 591  N  L  T  I  S  N  V  T  L  E  D  Q  G  I  Y  C  C  S  A  H
2041 TAATTTGACCATATCTAATGTAACTTTAGAGGACCAAGGTATTTACTGCTGTTCAGCTCA
 611  T  A  L  D  S  A  A  D  I  T  Q  V  T  V  L  D  V  P  D  P
2101 TACTGCTCTAGACAGTGCTGCCGATATAACTCAAGTAACTGTTCTTGATGTTCCGGATCC
 631  P  E  N  L  H  L  S  E  R  Q  N  R  S  V  R  L  T  W  E  A
2161 ACCAGAAAACCTTCACTTGTCTGAAAGACAGAACAGGAGTGTTCGGCTGACCTGGGAAGC
 651  G  A  D  H  N  S  N  I  S  E  Y  I  V  E  F  E  G  N  K  E
2221 TGGAGCTGACCACAACAGCAATATTAGCGAGTATATTGTTGAATTTGAAGGAAACAAAGA
 671  E  P  G  R  W  E  E  L  T  R  V  Q  G  K  K  T  T  V  I  L
2281 AGAGCCTGGAAGGTGGGAGGAACTGACCAGAGTCCAAGGAAAGAAAACCACAGTTATCTT
 691  P  L  A  P  F  V  R  Y  Q  F  R  V  I  A  V  N  E  V  G  R
2341 ACCTTTGGCTCCATTTGTGAGATACCAGTTCAGGGTCATAGCCGTGAACGAAGTAGGGAG
 711  S  Q  P  S  Q  P  S  D  H  H  E  T  P  P  A  A  P  D  R  N
2401 AAGTCAGCCTAGCCAGCCGTCAGACCATCATGAAACACCACCAGCAGCTCCAGATAGGAA
 731  P  Q  N  I  R  V  Q  A  S  Q  P  K  E  M  I  I  K  W  E  P
2461 TCCACAAAACATAAGGGTTCAAGCCTCTCAACCCAAGGAAATGATTATAAAGTGGGAGCC
 751  L  K  S  M  E  Q  N  G  P  G  L  E  Y  R  V  T  W  K  P  Q
2521 TTTGAAATCCATGGAGCAGAATGGACCAGGCCTAGAGTACAGAGTGACCTGGAAGCCACA
 771  G  A  P  V  E  W  E  E  E  T  V  T  N  H  T  L  R  V  M  T
2581 GGGAGCCCCAGTGGAGTGGGAAGAAGAAACAGTCACAAACCACACATTGCGGGTGATGAC
 791  P  A  V  Y  A  P  Y  D  V  K  V  Q  A  I  N  Q  L  G  S  G
2641 GCCTGCTGTCTATGCCCCTTATGATGTCAAGGTCCAGGCTATCAATCAACTAGGATCTGG
 811  P  D  P  Q  S  V  T  L  Y  S  G  E  D  Y  P  D  T  A  P  V
2701 GCCTGACCCTCAGTCAGTGACTCTCTATTCTGGAGAAGACTATCCTGATACAGCTCCAGT
 831  I  H  G  V  D  V  I  N  S  T  L  V  K  V  T  W  S  T  V  P
2761 GATCCATGGGGTGGACGTTATAAACAGTACATTAGTTAAAGTTACCTGGTCAACAGTTCC
```

Fig. 2J-4

```
851  K  D  R  V  H  G  R  L  K  G  Y  Q  I  N  W  W  K  T  K  S
2821 AAAGGACAGAGTACATGGACGTCTGAAAGGCTATCAGATAAATTGGTGGAAAACAAAAAG
871  L  L  D  G  R  T  H  P  K  E  V  N  I  L  R  F  S  G  Q  R
2881 TCTGTTGGATGGAAGAACACATCCCAAAGAAGTGAACATTCTAAGATTTTCAGGACAAAG
891  N  S  G  M  V  P  S  L  D  A  F  S  E  F  H  L  T  V  L  A
2941 AAACTCTGGAATGGTTCCTTCCTTAGATGCCTTTAGTGAATTTCATTTAACAGTCTTAGC
911  Y  N  S  K  G  A  G  P  E  S  E  P  Y  I  F  Q  T  P  E  G
3001 CTATAACTCTAAAGGAGCTGGTCCTGAAAGTGAGCCTTATATATTTCAAACACCAGAAGG
931  V  P  E  Q  P  T  F  L  K  V  I  K  V  D  K  D  T  A  T  L
3061 AGTACCTGAACAGCCAACTTTTCTAAAGGTCATCAAAGTTGATAAAGACACTGCCACTTT
951  S  W  G  L  P  K  K  L  N  G  N  L  T  G  Y  L  L  Q  Y  Q
3121 ATCTTGGGGACTACCTAAGAAATTAAATGGAAACTTAACTGGCTATCTTTTGCAATATCA
971  I  I  N  D  T  Y  E  I  G  E  L  N  D  I  N  I  T  T  P  S
3181 GATAATAAATGACACCTACGAGATTGGAGAATTAAATGATATTAACATTACAACTCCATC
991  K  P  S  W  H  L  S  N  L  N  A  T  T  K  Y  K  F  Y  L  R
3241 AAAGCCCAGCTGGCACCTCTCAAACCTGAATGCAACTACCAAGTACAAATTCTACTTGAG
1011 A  C  T  S  Q  G  C  G  K  P  I  T  E  E  S  S  T  L  G  E
3301 GGCTTGCACTTCACAGGGCTGTGGAAAACCGATCACGGAGGAAAGCTCCACCTTAGGAGA
1031 G  S  K  G  I  G  K  I  S  G  V  N  L  T  Q  K  T  H  P  I
3361 AGGGAGTAAAGGTATCGGGAAGATATCAGGAGTAAATCTTACTCAAAAGACTCACCCAAT
1051 E  V  F  E  P  G  A  E  H  I  V  R  L  M  T  K  N  W  G  D
3421 AGAGGTATTTGAGCCGGGAGCTGAACATATAGTTCGCCTAATGACTAAGAATTGGGGCGA
1071 N  D  S  I  F  Q  D  V  I  E  T  R  G  R  E  Y  A  G  L  Y
3481 TAACGATAGCATTTTTCAAGATGTAATTGAGACAAGAGGGAGAGAATATGCTGGTTTATA
1091 D  D  I  S  T  Q  G  W  F  I  G  L  M  C  A  I  A  L  L  T
3541 TGATGACATCTCCACTCAAGGCTGGTTTATTGGACTGATGTGTGCGATTGCTCTTCTCAC
1111 L  L  L  L  T  V  C  F  V  K  R  N  R  G  G  K  Y  S  V  K
3601 ACTACTATTATTAACTGTTTGCTTTGTGAAGAGGAATAGAGGTGGAAAGTACTCAGTTAA
1131 E  K  E  D  L  H  P  D  P  E  I  Q  S  V  K  D  E  T  F  G
3661 AGAAAAGGAAGATTTGCATCCAGACCCAGAAATTCAGTCAGTAAAAGATGAAACCTTTGG
1151 E  Y  S  D  S  D  E  K  P  L  K  G  S  L  R  S  L  N  R  D
3721 TGAATACAGTGACAGTGATGAAAAGCCTCTCAAAGGAAGCCTTCGGTCCCTTAATAGGGA
1171 M  Q  P  T  E  S  A  D  S  L  V  E  Y  G  E  G  D  H  G  L
3781 TATGCAGCCTACTGAAAGTGCTGACAGCTTAGTCGAATACGGAGAGGGAGACCATGGTCT
1191 F  S  E  D  G  S  F  I  G  A  Y  A  G  S  K  E  K  G  S  V
3841 CTTCAGTGAAGATGGATCATTTATTGGTGCCTACGCTGGATCTAAGGAGAAGGGATCTGT
1211 E  S  N  G  S  S  T  A  T  F  P  L  R  A  *
3901 TGAAAGCAATGGAAGTTCTACAGCAACTTTTCCCCTTCGGGCATAAacacaacatatgta
3961 agcaacgctactggttcaccccaaccttccatatttatctgttcaaaggagcaagaactt
4021 tcatataggaatagaaacatgctggccgaagatttcatccagaagtcaacatcctgcaat
4081 tatgttgaaaagagtagtactttcttcaaaatataaaatgccaagcacttcaggcctatg
```

Fig. 2J-5

4141 ttttgcttatattgttttcaggtgctcaaaatgcaaaacacaaaacaaatcctgcattta
4201 gatacacctcaactaaatccaaagtccccattcagtatattccatatttgcctgatttta
4261 ctattcggtgtgtttgcatagatgttgctacttggtgggtttttctccgtatgcacattg
4321 gtatacagtctctgagaactggcttggtgactttgcttcactacaggttaaaagaccata
4381 agcaaactggttatttaaaatgtaaaaaggaatatgaaagtcttattaaaacacttcatt
4441 gaaaatatacagtctaaatttattatttaaattttactagcaaaagtcttaggtgaacaa
4501 tcaactagtatttgttgagctcctatttgcccagagatggtcatatttaaacagaagtat
4561 acgtttttcagtttcaacatgaatttttttatttctgtcagttatgacatccacgagcat
4621 cactttttgtgtctgtttttttttttttcttggactaaattcaactgcatggaagcggt
4681 ggtcagaaggttgttttatacgagaacaggcagaaagtgcccattgttcaggattctaat
4741 agctacatctacttaatatcttcatttctaaattgactgcttttaccttttctcatgtt
4801 tatataatggtatgcttgcatatatttcatgaatacattgtacatattatgttaatattt
4861 acacaatttaaaatatagatgtgttttattttgaagtgagaaaatgaacattaacaggca
4921 tgtttgtacagctagaatatattagtaagatactgtttttcgtcattccagagctacaac
4981 taataacacgaggttccaaagctgaagactttgtataaagtatttgggttttgttcttgt
5041 attgctttctttcaacagtttcaaaataaaatatcatacaaatattgagggaaatgtttt
5101 catatttttcaaaataggttttattgttgaatgtacatctaccccagcccctcaaaaga
5161 aaaactgtttacatagaaattcctacacatacgtttgcgtatatgttattttaaacatct
5221 ttgtggtgagaatttttccccgatattctccttctgtcaaagtcagaacaaattcaggg
5281 aatttatttctggcagttgtgctccagtccttttaaaattgtacatgaacatgttttag
5341 aaacaatatggaggatgatgcatacatgtcggtcaagttcagcgctcgacattttatgga
5401 aagatttttttaaccttaccacgaaatacttaactactgtttaagtgaattgacttattt
5461 cactttagtttttgaactgtgattattggtatactgttatatcctcaacttggatttatg
5521 gtaacccctttagttcatggagaccaaaatttggggtatttataatagtcagcgcagga
5581 atgcacatggaatatctacttgtccttttgaacctcacgagtcatccagaatgtatagac
5641 aggaaaagcatgtcttatttaaaactgtaatttatgggctcaggatctgaccgcagtccc
5701 gggagtaagcatttcaaagggggaaggcagtgtggtccctaccctgtgtgaatgtgagga
5761 tgtagacatccatcagtgcaactcgagctccatcctcctccgatttctaaggctccagtt
5821 ttctggagggacagtcatcatgttttgatttatctgggagaaaactgtggtgcacagctt
5881 gtgaggagggcaaggttgtgacgttcgagcttagttctggtgttattctgtctcctcttc
5941 tttgtcatcagccaaaacgtggtttttaaagagagtcatgcaggttagaaataatgtcaa
6001 aaatatttaggaatttaataacctttaagtcagaaactaaaacaaatactgaaatattag
6061 ctcttcctacacttcgtgttcccctttagctgcctgaaaatcaagattgctcctactcag
6121 atcttctgagtggctaaaacttatggatatgaaaaatgagattgaatgatgactatgctt
6181 tgctatcattgttacctttcctcaatactatttggcaactactgggactcttcagcacaa
6241 aaggaatagatctatgattgaccctgattttaattgtgaaattatatgattcatatattt
6301 tatgaatcagaataaccttcaaataaaataaatctaagtcggttaaaatggatttcatga
6361 ttttccctcagaaaatgagtaacggagtccacggcgtgcaatggtaattataaattggtg
6421 atgcttgtttgcaaattgcccactcgtgataagtcaacagccaatatttaaaactttgtt
6481 cgttactggctttaccctaactttctctagtctactgtcaatatcattttaatgtaattg
6541 attgtatatagtctcaagaatggttggtgggcatgagttcctagagaactgtccaagggt

Fig. 2J-6

6601 tgggaaaatccaaattctcttcctggctccagcactgattttgtacataaacattaggca
6661 ggttgcttaaccttttatttcaaactctctcaactctaaagtgctaataataatctcag
6721 ttaccttatctttgtcacagggtgttctttttatgaagaaaaatttgaaaatgataaaa
6781 gctaagatgccttctaacttcataagcaaacctttaactaattatgtatctgaaagtcac
6841 ccccacataccaactcaactttttcctgtgaacacataaatatatttttatagaaaaac
6901 aaatctacataaaataaatctactgtttagtgagcagtatgacttgtacatgccattgaa
6961 aattattaatcagaagaaaattaagcagggtctttgctatacaaaagtgttttccactaa
7021 ttttgcatgcgtatttataagaaaaatgtgaatttggtggttttattctatcggtataaa
7081 ggcatcgatattttagatgcacccgtgtttgtaaaaatgtagagcacaatggaattatgc
7141 tggaagtctcaaataatattttttcctattttatactcatggaagagataagctaaaga
7201 ggggacaataatgagaaatgttggtgtgcttttctaagcatttaaaacataattgccaat
7261 tgaaaccctaaatatgtttacataccattaagatatgattcatgtaacaatgttaaatta
7321 attataatgggattgggtttgttatctgtggtagtatatatcctagtgttcctatagtga
7381 aataagtagggttcagccaaagctttctttgttttgtaccttaaattgttcgattacgtc
7441 atcaaaagagatgaaaggtatgtagaacaggttcacgtgattaccttttcttttggctt
7501 ggattaatattcatagtagaactttataaaacgtgtttgtattgtaggtggtgtttgtat
7561 tatgcttatgactatgtatggtttgaaaatattttcattatacatgaaattcaactttcc
7621 aaataaaagttctacttcatgtaatccaaaa

Fig. 2K. 282P1G3 v.9 through v.25, SNP variants of 282P1G3 v.1. The 282P1G3 v.9 through v.23 proteins have 1224 amino acids. Variants 282P1G3 v.9 through v.25 are variants with single nucleotide difference from 282P1G3 v.1. 282P1G3 v.9, v.10, v.11, v.24 and v.25 proteins differ from 282P1G3 v.1 by one amino acid. 282P1G3 v.12 through v.23, v.26 and v.27 code for the same protein as v.1. Though these SNP variants are shown separately, they can also occur in any combinations and in any of the transcript variants listed above in Figures 2A through 2I.

| Variant | Nucleic acid position | Nucleic Acid Variation | Amino Acid Position | Amino Acid Variation |
|---|---|---|---|---|
| 282P1G3 v.9 | 320 | C/T | 17 | L=>F |
| 282P1G3 v.10 | 668 | C/T | 133 | L=>F |
| 282P1G3 v.11 | 1178 | A/G | 303 | T=>A |
| 282P1G3 v.12 | 3484 | C/T | *Silent variant* | |
| 282P1G3 v.13 | 4615 | G/A | *Silent variant* | |
| 282P1G3 v.15 | 5078 | C/T | *Silent variant* | |
| 282P1G3 v.16 | 5530 | T/A | *Silent variant* | |
| 282P1G3 v.17 | 5812 | C/T | *Silent variant* | |
| 282P1G3 v.18 | 6114 | A/G | *Silent variant* | |
| 282P1G3 v.19 | 6229 | C/T | *Silent variant* | |
| 282P1G3 v.20 | 6383 | G/A | *Silent variant* | |
| 282P1G3 v.21 | 6626 | C/T | *Silent variant* | |
| 282P1G3 v.22 | 6942 | C/T | *Silent variant* | |
| 282P1G3 v.23 | 7085 | C/T | *Silent variant* | |
| 282P1G3 v.24 | 2684 | A/G | 805 | N=>D |
| 282P1G3 v.25 | 3705 | T/C | 1198 | I=>T |
| 282P1G3 v.26 | 5768 | T/C | *Silent variant* | |
| 282P1G3 v.27 | 6125 | C/T | *Silent variant* | |

Fig. 3:

Fig. 3A. Amino acid sequence of 282P1G3 v.1 (SEQ ID. NO.: 20). The 282P1G3 v.1 protein has 1224 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFIGA
1201 YAGSKEKGSV ESNGSSTATF PLRA
```

Fig. 3B-1. Amino acid sequence of 282P1G3 v.2 (SEQ ID. NO.: 21). The 282P1G3 v.2 protein has 1171 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKFPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 REAKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
```

Fig. 3B-2

```
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GKYAGLYDDI STQGWFIGLM CAIALLTLLL LTVCFVKRNR GGKYSVKEKE
1081 DLHPDPEIQS VKDETFGEYS DSDEKPLKGS LRSLNRDMQP TESADSLVEY GEGDHGLFSE
1141 DGSFIGAYAG SKEKGSVESN GSSTATFPLR A
```

Fig. 3C. Amino acid sequence of 282P1G3 v.3 (SEQ ID. NO.: 22). The 282P1G3 v.3 protein has 893 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINTT
 841 YVSNATGSPQ PSIFICSKEQ ELSYRNRNML AEDFIQKSTS CNYVEKSSTF FKI
```

Fig. 3D-1. Amino acid sequence of 282P1G3 v.4 (SEQ ID. NO.: 23). The 282P1G3 v.4 protein has 1117 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
```

Fig. 3D-2

721 ETPPAAPDRN PQNIRVQASQ PKEMIIKWEP LKSMEQNGPG LEYRVTWKPQ GAPVEWEEET
781 VTNHTLRVMT PAVYAPYDVK VQAINQLGSG PDPQSVTLYS GEDLPEQPTF LKVIKVDKDT
841 ATLSWGLPKK LNGNLTGYLL QYQIINDTYE IGELNDINIT TPSKPSWHLS NLNATTKYKF
901 YLRACTSQGC GKPITEESST LGEGSKGIGK ISGVNLTQKT HPIEVFEPGA EHIVRLMTKN
961 WGDNDSIFQD VIETRGREYA GLYDDISTQG WFIGLMCAIA LLTLLLLTVC FVKRNRGGKY
1021 SVKEKEDLHP DPEIQSVKDE TFGEYSDSDE KPLKGSLRSL NRDMQPTESA DSLVEYGEGD
1081 HGLFSEDGSF IGAYAGSKEK GSVESNGSST ATFPLRA

Fig. 3E. Amino acid sequence of 282P1G3 v.5 (SEQ ID. NO.: 24). The 282P1G3 v.5 protein has 1208 amino acids.

1 MEPLLLGRGL IVYLMFLLLK FSKAIEIPSS VQQVPTIIKQ SKVQVAFPFD EYFQIECEAK
61 GNPEPTFSWT KDGNPFYFTD HRIIPSNNSG TFRIPNEGHI SHFQGKYRCF ASNKLGIAMS
121 EEIEFIVPSV PKLPKEKIDP LEVEEGDPIV LPCNPPKGLP PLHIYWMNIE LEHIEQDERV
181 YMSQKGDLYF ANVEEKDSRN DYCCFAAFPR LRTIVQKMPM KLTVNSSNSI KQRKPKLLLP
241 PTESGSESSI TILKGEILLL ECFAEGLPTP QVDWNKIGGD LPKGRETKEN YGKTLKIENV
301 SYQDKGNYRC TASNFLGTAT HDFHVIVEEP PRWTKKPQSA VYSTGSNGIL LCEAEGEPQP
361 TIKWRVNGSP VDNHPFAGDV VFPREISFTN LQPNHTAVYQ CEASNVHGTI LANANIDVVD
421 VRPLIQTKDG ENYATVVGYS AFLHCEFFAS PEAVVSWQKV EEVKPLEGRR YHIYENGTLQ
481 INRTTEEDAG SYSCWVENAI GKTAVTANLD IRNATKLRVS PKNPRIPKLH MLELHCESKC
541 DSHLKHSLKL SWSKDGEAFE INGTEDGRII IDGANLTISN VTLEDQGIYC CSAHTALDSA
601 ADITQVTVLD VPDPPENLHL SERQNRSVRL TWEAGADHNS NISEYIVEFE GNKEEPGRWE
661 ELTRVQGKKT TVILPLAPFV RYQFRVIAVN EVGRSQPSQP SDHHETPPAA PDRNPQNIRV
721 QASQPKEMII KWEPLKSMEQ NGPGLEYRVT WKPQGAPVEW EEETVTNHTL RVMTPAVYAP
781 YDVKVQAINQ LGSGPDPQSV TLYSGEDYPD TAPVIHGVDV INSTLVKVTW STVPKDRVHG
841 RLKGYQINWW KTKSLLDGRT HPKEVNILRF SGQRNSGMVP SLDAFSEFHL TVLAYNSKGA
901 GPESEPYIFQ TPEGVPEQPT FLKVIKVDKD TATLSWGLPK KLNGNLTGYL LQYQIINDTY
961 EIGELNDINI TTPSKPSWHL SNLNATTKYK FYLRACTSQG CGKPITEESS TLGEGSKGIG
1021 KISGVNLTQK THPIEVFEPG AEHIVRLMTK NWGDNDSIFQ DVIETRGREY AGLYDDISTQ
1081 GWFIGLMCAI ALLTLLLLTV CFVKRNRGGK YSVKEKEDLH PDPEIQSVKD ETFGEYSDSD
1141 EKPLKGSLRS LNRDMQPTES ADSLVEYGEG DHGLFSEDGS FIGAYAGSKE KGSVESNGSS
1201 TATFPLRA

Fig. 3F-1. Amino acid sequence of 282P1G3 v.6 (SEQ ID. NO.: 25). The 282P1G3 v.6 protein has 1183 amino acids.

1 MEPLLLGRGL IVYLMFLLLK FSKAIEIPSS VQQVPTIIKQ SKVQVAFPFD EYFQIECEAK
61 GNPEPTFSWT KDGNPFYFTD HRIIPSNNSG TFRIPNEGHI SHFQGKYRCF ASNKLGIAMS
121 EEIEFIVPKL EHIEQDERVY MSQKGDLYFA NVEEKDSRND YCCFAAFPRL RTIVQKMPMK
181 LTVNSLKHAN DSSSSTEIGS KANSIKQRKP KLLLPPTESG SESSITILKG EILLLECFAE
241 GLPTPQVDWN KIGGDLPKGR ETKENYGKTL KIENVSYQDK GNYRCTASNF LGTATHDFHV
301 IVEEPPRWTK KPQSAVYSTG SNGILLCEAE GEPQPTIKWR VNGSPVDNHP FAGDVVFPRE

Fig. 3F-2

361 ISFTNLQPNH TAVYQCEASN VHGTILANAN IDVVDVRPLI QTKDGENYAT VVGYSAFLHC
421 EFFASPEAVV SWQKVEEVKP LEGRRYHIYE NGTLQINRTT EEDAGSYSCW VENAIGKTAV
481 TANLDIRNAT KLRVSPKNPR IPKLHMLELH CESKCDSHLK HSLKLSWSKD GEAFEINGTE
541 DGRIIIDGAN LTISNVTLED QGIYCCSAHT ALDSAADITQ VTVLDVPDPP ENLHLSERQN
601 RSVRLTWEAG ADHNSNISEY IVEFEGNKEE PGRWEELTRV QGKKTTVILP LAPFVRYQFR
661 VIAVNEVGRS QPSQPSDHHE TPPAAPDRNP QNIRVQASQP KEMIIKWEPL KSMEQNGPGL
721 EYRVTWKPQG APVEWEEETV TNHTLRVMTP AVYAPYDVKV QAINQLGSGP DPQSVTLYSG
781 EDYPDTAPVI HGVDVINSTL VKVTWSTVPK DRVHGRLKGY QINWWKTKSL LDGRTHPKEV
841 NILRFSGQRN SGMVPSLDAF SEFHLTVLAY NSKGAGPESE PYIFQTPEGV PEQPTFLKVI
901 KVDKDTATLS WGLPKKLNGN LTGYLLQYQI INDTYEIGEL NDINITTPSK PSWHLSNLNA
961 TTKYKFYLRA CTSQGCGKPI TEESSTLGEG SKGIGKISGV NLTQKTHPIE VFEPGAEHIV
1021 RLMTKNWGDN DSIFQDVIET RGREYAGLYD DISTQGWFIG LMCAIALLTL LLLTVCFVKR
1081 NRGGKYSVKE KEDLHPDPEI QSVKDETFGE YSDSDEKPLK GSLRSLNRDM QPTESADSLV
1141 EYGEGDHGLF SEDGSFIGAY AGSKEKGSVE SNGSSTATFP LRA

Fig. 3G. Amino acid sequence of 282P1G3 v.7 (SEQ ID. NO.: 26). The 282P1G3 v.7 protein has 1236 amino acids.

1 MEPLLLGRGL IVYLMFLLLK FSKAIEIPSS VQQVPTIIKQ SKVQVAFPFD EYFQIECEAK
61 GNPEPTFSWT KDGNPFYFTD HRIIPSNNSG TFRIPNEGHI SHFQGKYRCF ASNKLGIAMS
121 EEIEFIVPSV PKLPKEKIDP LEVEEGDPIV LPCNPPKGLP PLHIYWMNIE LEHIEQDERV
181 YMSQKGDLYF ANVEEKDSRN DYCCFAAFPR LRTIVQKMPM KLTVNSLKHA NDSSSSTEIG
241 SKANSIKQRK PKLLLPPTES GSESSITILK GEILLLECFA EGLPTPQVDW NKIGGDLPKG
301 RETKENYGKT LKIENVSYQD KGNYRCTASN FLGTATHDFH VIVEDNISHE LFTLHPEPPR
361 WTKKPQSAVY STGSNGILLC EAEGEPQPTI KWRVNGSPVD NHPFAGDVVF PREISFTNLQ
421 PNHTAVYQCE ASNVHGTILA NANIDVVDVR PLIQTKDGEN YATVVGYSAF LHCEFFASPE
481 AVVSWQKVEE VKPLEGRRYH IYENGTLQIN RTTEEDAGSY SCWVENAIGK TAVTANLDIR
541 NATKLRVSPK NPRIPKLHML ELHCESKCDS HLKHSLKLSW SKDGEAFEIN GTEDGRIIID
601 GANLTISNVT LEDQGIYCCS AHTALDSAAD ITQVTVLDVP DPPENLHLSE RQNRSVRLTW
661 EAGADHNSNI SEYIVEFEGN KEEPGRWEEL TRVQGKKTTV ILPLAPFVRY QFRVIAVNEV
721 GRSQPSQPSD HHETPPAAPD RNPQNIRVQA SQPKEMIIKW EPLKSMEQNG PGLEYRVTWK
781 PQGAPVEWEE ETVTNHTLRV MTPAVYAPYD VKVQAINQLG SGPDPQSVTL YSGEDYPDTA
841 PVIHGVDVIN STLVKVTWST VPKDRVHGRL KGYQINWWKT KSLLDGRTHP KEVNILRFSG
901 QRNSGMVPSL DAFSEFHLTV LAYNSKGAGP ESEPYIFQTP EGVPEQPTFL KVIKVDKDTA
961 TLSWGLPKKL NGNLTGYLLQ YQIINDTYEI GELNDINITT PSKPSWHLSN LNATTKYKFY
1021 LRACTSQGCG KPITEESSTL GEGSKGIGKI SGVNLTQKTH PIEVFEPGAE HIVRLMTKNW
1081 GDNDSIFQDV IETRGREYAG LYDDISTQGW FIGLMCAIAL LTLLLLTVCF VKRNRGGKYS
1141 VKEKEDLHPD PEIQSVKDET FGEYSDSDEK PLKGSLRSLN RDMQPTESAD SLVEYGEGDH
1201 GLFSEDGSFI GAYAGSKEKG SVESNGSSTA TFPLRA

Fig. 3H. Amino acid sequence of 282P1G3 v.8 (SEQ ID. NO.: 27). The 282P1G3 v.8 protein has 1195 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPKL EHIEQDERVY MSQKGDLYFA NVEEKDSRND YCCFAAFPRL RTIVQKMPMK
 181 LTVNSLKHAN DSSSSTEIGS KANSIKQRKP KLLLPPTESG SESSITILKG EILLLECFAE
 241 GLPTPQVDWN KIGGDLPKGR ETKENYGKTL KIENVSYQDK GNYRCTASNF LGTATHDFHV
 301 IVEDNISHEL FTLHPEPPRW TKKPQSAVYS TGSNGILLCE AEGEPQPTIK WRVNGSPVDN
 361 HPFAGDVVFP REISFTNLQP NHTAVYQCEA SNVHGTILAN ANIDVVDVRP LIQTKDGENY
 421 ATVVGYSAFL HCEFFASPEA VVSWQKVEEV KPLEGRRYHI YENGTLQINR TTEEDAGSYS
 481 CWVENAIGKT AVTANLDIRN ATKLRVSPKN PRIPKLHMLE LHCESKCDSH LKHSLKLSWS
 541 KDGEAFEING TEDGRIIIDG ANLTISNVTL EDQGIYCCSA HTALDSAADI TQVTVLDVPD
 601 PPENLHLSER QNRSVRLTWE AGADHNSNIS EYIVEFEGNK EEPGRWEELT RVQGKKTTVI
 661 LPLAPFVRYQ FRVIAVNEVG RSQPSQPSDH HETPPAAPDR NPQNIRVQAS QPKEMIIKWE
 721 PLKSMEQNGP GLEYRVTWKP QGAPVEWEEE TVTNHTLRVM TPAVYAPYDV KVQAINQLGS
 781 GPDPQSVTLY SGEDYPDTAP VIHGVDVINS TLVKVTWSTV PKDRVHGRLK GYQINWWKTK
 841 SLLDGRTHPK EVNILRFSGQ RNSGMVPSLD AFSEFHLTVL AYNSKGAGPE SEPYIFQTPE
 901 GVPEQPTFLK VIKVDKDTAT LSWGLPKKLN GNLTGYLLQY QIINDTYEIG ELNDINITTP
 961 SKPSWHLSNL NATTKYKFYL RACTSQGCGK PITEESSTLG EGSKGIGKIS GVNLTQKTHP
1021 IEVFEPGAEH IVRLMTKNWG DNDSIFQDVI ETRGREYAGL YDDISTQGWF IGLMCAIALL
1081 TLLLLTVCFV KRNRGGKYSV KEKEDLHPDP EIQSVKDETF GEYSDSDEKP LKGSLRSLNR
1141 DMQPTESADS LVEYGEGDHG LFSEDGSFIG AYAGSKEKGS VESNGSSTAT FPLRA
```

Fig. 3I-1. Amino acid sequence of 282P1G3 v.9 (SEQ ID. NO.: 28). The 282P1G3 v.9 protein has 1224 amino acids.

```
   1 MEPLLLGRGL IVYLMFFLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
```

Fig. 3I-2

```
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFIGA
1201 YAGSKEKGSV ESNGSSTATF PLRA
```

Fig. 3J. Amino acid sequence of 282P1G3 v.10 (SEQ ID. NO.: 29). The 282P1G3 v.10 protein has 1224 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKFPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFIGA
1201 YAGSKEKGSV ESNGSSTATF PLRA
```

Fig. 3K-1. Amino acid sequence of 282P1G3 v.11 (SEQ ID. NO.: 30). The 282P1G3 v.11 protein has 1224 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 REAKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
```

Fig. 3K-2

```
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFIGA
1201 YAGSKEKGSV ESNGSSTATF PLRA
```

Fig. 3L. Amino acid sequence of 282P1G3 v.24 (SEQ ID. NO.: 31). The 282P1G3 v.24 protein has 1224 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAIDQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFIGA
1201 YAGSKEKGSV ESNGSSTATF PLRA
```

Fig. 3M. Amino acid sequence of 282P1G3 v.25 (SEQ ID. NO.: 32). The 282P1G3 v.25 protein has 1224 amino acids.

```
   1 MEPLLLGRGL IVYLMFLLLK FSKAIEIPSS VQQVPTIIKQ SKVQVAFPFD EYFQIECEAK
  61 GNPEPTFSWT KDGNPFYFTD HRIIPSNNSG TFRIPNEGHI SHFQGKYRCF ASNKLGIAMS
 121 EEIEFIVPSV PKLPKEKIDP LEVEEGDPIV LPCNPPKGLP PLHIYWMNIE LEHIEQDERV
 181 YMSQKGDLYF ANVEEKDSRN DYCCFAAFPR LRTIVQKMPM KLTVNSLKHA NDSSSSTEIG
 241 SKANSIKQRK PKLLLPPTES GSESSITILK GEILLLECFA EGLPTPQVDW NKIGGDLPKG
 301 RETKENYGKT LKIENVSYQD KGNYRCTASN FLGTATHDFH VIVEEPPRWT KKPQSAVYST
 361 GSNGILLCEA EGEPQPTIKW RVNGSPVDNH PFAGDVVFPR EISFTNLQPN HTAVYQCEAS
 421 NVHGTILANA NIDVVDVRPL IQTKDGENYA TVVGYSAFLH CEFFASPEAV VSWQKVEEVK
 481 PLEGRRYHIY ENGTLQINRT TEEDAGSYSC WVENAIGKTA VTANLDIRNA TKLRVSPKNP
 541 RIPKLHMLEL HCESKCDSHL KHSLKLSWSK DGEAFEINGT EDGRIIIDGA NLTISNVTLE
 601 DQGIYCCSAH TALDSAADIT QVTVLDVPDP PENLHLSERQ NRSVRLTWEA GADHNSNISE
 661 YIVEFEGNKE EPGRWEELTR VQGKKTTVIL PLAPFVRYQF RVIAVNEVGR SQPSQPSDHH
 721 ETPPAAPDRN PQNIRVQASQ PKEMIIKWEP LKSMEQNGPG LEYRVTWKPQ GAPVEWEEET
 781 VTNHTLRVMT PAVYAPYDVK VQAINQLGSG PDPQSVTLYS GEDYPDTAPV IHGVDVINST
 841 LVKVTWSTVP KDRVHGRLKG YQINWWKTKS LLDGRTHPKE VNILRFSGQR NSGMVPSLDA
 901 FSEFHLTVLA YNSKGAGPES EPYIFQTPEG VPEQPTFLKV IKVDKDTATL SWGLPKKLNG
 961 NLTGYLLQYQ IINDTYEIGE LNDINITTPS KPSWHLSNLN ATTKYKFYLR ACTSQGCGKP
1021 ITEESSTLGE GSKGIGKISG VNLTQKTHPI EVFEPGAEHI VRLMTKNWGD NDSIFQDVIE
1081 TRGREYAGLY DDISTQGWFI GLMCAIALLT LLLLTVCFVK RNRGGKYSVK EKEDLHPDPE
1141 IQSVKDETFG EYSDSDEKPL KGSLRSLNRD MQPTESADSL VEYGEGDHGL FSEDGSFTGA
1201 YAGSKEKGSV ESNGSSTATF PLRA
```

Fig. 4:

Fig. 4A-1: Alignment of 282P1G3 (SEQ ID NO: 33) with human close homolog of L1 (gi 27894376) (SEQ ID NO: 34)

Score = 2513 bits (6513), Expect = 0.0
Identities = 1223/1224 (99%), Positives = 1223/1224 (99%)

```
Query: 1    MEPLLLGRGLIVYLMFLLLKFSKAIEIPSSVQQVPTIIKQSKVQVAFPFDEYFQIECEAK 60
            MEPLLLGRGLIVYLMFLLLKFSKAIEIPSSVQQVPTIIKQSKVQVAFPFDEYFQIECEAK
Sbjct: 1    MEPLLLGRGLIVYLMFLLLKFSKAIEIPSSVQQVPTIIKQSKVQVAFPFDEYFQIECEAK 60

Query: 61   GNPEPTFSWTKDGNPFYFTDHRIIPSNNSGTFRIPNEGHISHFQGKYRCFASNKLGIAMS 120
            GNPEPTFSWTKDGNPFYFTDHRIIPSNNSGTFRIPNEGHISHFQGKYRCFASNKLGIAMS
Sbjct: 61   GNPEPTFSWTKDGNPFYFTDHRIIPSNNSGTFRIPNEGHISHFQGKYRCFASNKLGIAMS 120

Query: 121  EEIEFIVPSVPKLPKEKIDPLEVEEGDPIVLPCNPPKGLPPLHIYWMNIELEHIEQDERV 180
            EEIEFIVPSVPK PKEKIDPLEVEEGDPIVLPCNPPKGLPPLHIYWMNIELEHIEQDERV
Sbjct: 121  EEIEFIVPSVPKFPKEKIDPLEVEEGDPIVLPCNPPKGLPPLHIYWMNIELEHIEQDERV 180

Query: 181  YMSQKGDLYFANVEEKDSRNDYCCFAAFPRLRTIVQKMPMKLTVNSLKHANDSSSSTEIG 240
            YMSQKGDLYFANVEEKDSRNDYCCFAAFPRLRTIVQKMPMKLTVNSLKHANDSSSSTEIG
Sbjct: 181  YMSQKGDLYFANVEEKDSRNDYCCFAAFPRLRTIVQKMPMKLTVNSLKHANDSSSSTEIG 240

Query: 241  SKANSIKQRKPKLLLPPTESGSESSITILKGEILLLECFAEGLPTPQVDWNKIGGDLPKG 300
            SKANSIKQRKPKLLLPPTESGSESSITILKGEILLLECFAEGLPTPQVDWNKIGGDLPKG
Sbjct: 241  SKANSIKQRKPKLLLPPTESGSESSITILKGEILLLECFAEGLPTPQVDWNKIGGDLPKG 300

Query: 301  RETKENYGKTLKIENVSYQDKGNYRCTASNFLGTATHDFHVIVEEPPRWTKKPQSAVYST 360
            RETKENYGKTLKIENVSYQDKGNYRCTASNFLGTATHDFHVIVEEPPRWTKKPQSAVYST
Sbjct: 301  RETKENYGKTLKIENVSYQDKGNYRCTASNFLGTATHDFHVIVEEPPRWTKKPQSAVYST 360

Query: 361  GSNGILLCEAEGEPQPTIKWRVNGSPVDNHPFAGDVVFPREISFTNLQPNHTAVYQCEAS 420
            GSNGILLCEAEGEPQPTIKWRVNGSPVDNHPFAGDVVFPREISFTNLQPNHTAVYQCEAS
Sbjct: 361  GSNGILLCEAEGEPQPTIKWRVNGSPVDNHPFAGDVVFPREISFTNLQPNHTAVYQCEAS 420

Query: 421  NVHGTILANANIDVVDVRPLIQTKDGENYATVVGYSAFLHCEFFASPEAVVSWQKVEEVK 480
            NVHGTILANANIDVVDVRPLIQTKDGENYATVVGYSAFLHCEFFASPEAVVSWQKVEEVK
Sbjct: 421  NVHGTILANANIDVVDVRPLIQTKDGENYATVVGYSAFLHCEFFASPEAVVSWQKVEEVK 480

Query: 481  PLEGRRYHIYENGTLQINRTTEEDAGSYSCWVENAIGKTAVTANLDIRNATKLRVSPKNP 540
            PLEGRRYHIYENGTLQINRTTEEDAGSYSCWVENAIGKTAVTANLDIRNATKLRVSPKNP
Sbjct: 481  PLEGRRYHIYENGTLQINRTTEEDAGSYSCWVENAIGKTAVTANLDIRNATKLRVSPKNP 540

Query: 541  RIPKLHMLELHCESKCDSHLKHSLKLSWSKDGEAFEINGTEDGRIIIDGANLTISNVTLE 600
            RIPKLHMLELHCESKCDSHLKHSLKLSWSKDGEAFEINGTEDGRIIIDGANLTISNVTLE
Sbjct: 541  RIPKLHMLELHCESKCDSHLKHSLKLSWSKDGEAFEINGTEDGRIIIDGANLTISNVTLE 600

Query: 601  DQGIYCCSAHTALDSAADITQVTVLDVPDPPENLHLSERQNRSVRLTWEAGADHNSNISE 660
            DQGIYCCSAHTALDSAADITQVTVLDVPDPPENLHLSERQNRSVRLTWEAGADHNSNISE
Sbjct: 601  DQGIYCCSAHTALDSAADITQVTVLDVPDPPENLHLSERQNRSVRLTWEAGADHNSNISE 660

Query: 661  YIVEFEGNKEEPGRWEELTRVQGKKTTVILPLAPFVRYQFRVIAVNEVGRSQPSQPSDHH 720
            YIVEFEGNKEEPGRWEELTRVQGKKTTVILPLAPFVRYQFRVIAVNEVGRSQPSQPSDHH
Sbjct: 661  YIVEFEGNKEEPGRWEELTRVQGKKTTVILPLAPFVRYQFRVIAVNEVGRSQPSQPSDHH 720

Query: 721  ETPPAAPDRNPQNIRVQASQPKEMIIKWEPLKSMEQNGPGLEYRVTWKPQGAPVEWEEET 780
            ETPPAAPDRNPQNIRVQASQPKEMIIKWEPLKSMEQNGPGLEYRVTWKPQGAPVEWEEET
Sbjct: 721  ETPPAAPDRNPQNIRVQASQPKEMIIKWEPLKSMEQNGPGLEYRVTWKPQGAPVEWEEET 780

Query: 781  VTNHTLRVMTPAVYAPYDVKVQAINQLGSGPDPQSVTLYSGEDYPDTAPVIHGVDVINST 840
            VTNHTLRVMTPAVYAPYDVKVQAINQLGSGPDPQSVTLYSGEDYPDTAPVIHGVDVINST
Sbjct: 781  VTNHTLRVMTPAVYAPYDVKVQAINQLGSGPDPQSVTLYSGEDYPDTAPVIHGVDVINST 840

Query: 841  LVKVTWSTVPKDRVHGRLKGYQINWWKTKSLLDGRTHPKEVNILRFSGQRNSGMVPSLDA 900
            LVKVTWSTVPKDRVHGRLKGYQINWWKTKSLLDGRTHPKEVNILRFSGQRNSGMVPSLDA
Sbjct: 841  LVKVTWSTVPKDRVHGRLKGYQINWWKTKSLLDGRTHPKEVNILRFSGQRNSGMVPSLDA 900

Query: 901  FSEFHLTVLAYNSKGAGPESEPYIFQTPEGVPEQPTFLKVIKVDKDTATLSWGLPKKLNG 960
            FSEFHLTVLAYNSKGAGPESEPYIFQTPEGVPEQPTFLKVIKVDKDTATLSWGLPKKLNG
```

Fig. 4A-2

```
Sbjct: 901  FSEFHLTVLAYNSKGAGPESEPYIFQTPEGVPEQPTFLKVIKVDKDTATLSWGLPKKLNG 960

Query: 961  NLTGYLLQYQIINDTYEIGELNDINITTPSKPSWHLSNLNATTKYKFYLRACTSQGCGKP 1020
             NLTGYLLQYQIINDTYEIGELNDINITTPSKPSWHLSNLNATTKYKFYLRACTSQGCGKP
Sbjct: 961  NLTGYLLQYQIINDTYEIGELNDINITTPSKPSWHLSNLNATTKYKFYLRACTSQGCGKP 1020

Query: 1021 ITEESSTLGEGSKGIGKISGVNLTQKTHPIEVFEPGAEHIVRLMTKNWGDNDSIFQDVIE 1080
             ITEESSTLGEGSKGIGKISGVNLTQKTHPIEVFEPGAEHIVRLMTKNWGDNDSIFQDVIE
Sbjct: 1021 ITEESSTLGEGSKGIGKISGVNLTQKTHPIEVFEPGAEHIVRLMTKNWGDNDSIFQDVIE 1080

Query: 1081 TRGREYAGLYDDISTQGWFIGLMCAIALLTLLLLTVCFVKRNRGGKYSVKEKEDLHPDPE 1140
             TRGREYAGLYDDISTQGWFIGLMCAIALLTLLLLTVCFVKRNRGGKYSVKEKEDLHPDPE
Sbjct: 1081 TRGREYAGLYDDISTQGWFIGLMCAIALLTLLLLTVCFVKRNRGGKYSVKEKEDLHPDPE 1140

Query: 1141 IQSVKDETFGEYSDSDEKPLKGSLRSLNRDMQPTESADSLVEYGEGDHGLFSEDGSFIGA 1200
             IQSVKDETFGEYSDSDEKPLKGSLRSLNRDMQPTESADSLVEYGEGDHGLFSEDGSFIGA
Sbjct: 1141 IQSVKDETFGEYSDSDEKPLKGSLRSLNRDMQPTESADSLVEYGEGDHGLFSEDGSFIGA 1200

Query: 1201 YAGSKEKGSVESNGSSTATFPLRA 1224
             YAGSKEKGSVESNGSSTATFPLRA
Sbjct: 1201 YAGSKEKGSVESNGSSTATFPLRA 1224
```

Fig. 4B-1: Alignment of 282P1G3 (SEQ ID NO: 35) with mouse close homolog of L1 (gi6680936) (SEQ ID NO: 36)

Score = 2057 bits (5330), Expect = 0.0
Identities = 1011/1225 (82%), Positives = 1100/1225 (89%), Gaps = 18/1225 (1%)

```
Query: 1    MEPLLLGRGLIVYLMFLLLKFSKAIEIPSSVQQVPTIIKQSKVQVAFPFDEYFQIECEAK 60
            ME  L GRGLI+ L+FLLLK S A EIP SVQQVPTI+KQS VQVAFPFDEYFQIECEAK
Sbjct: 2    MELPLCGRGLILSLIFLLLKLSAA-EIPLSVQQVPTIVKQSYVQVAFPFDEYFQIECEAK 60

Query: 61   GNPEPTFSWTKDGNPFYFTDHRIIPSNNSGTFRIPNEGHISHFQGKYRCFASNKLGIAMS 120
            GNPEP FSWTKD  PF  +D RII +NNSGTF+IPNEGHISHFQGKYRCFASN+LG A+S
Sbjct: 61   GNPEPIFSWTKDDKPFDLSDPRIIAANNSGTFKIPNEGHISHFQGKYRCFASNRLGTAVS 120

Query: 121  EEIEFIVPSVPKLPKEKIDPLEVEEGDPIVLPCNPPKGLPPLHIYWMNIELEHIEQDERV 180
            EEIEFIVP VPK PKEKI+P++VEEGD IVLPCNPPKGLPPLHIYWMNIELEHIEQDERV
Sbjct: 121  EEIEFIVPGVPKFPKEKIEPIDVEEGDSIVLPCNPPKGLPPLHIYWMNIELEHIEQDERV 180

Query: 181  YMSQKGDLYFANVEEKDSRNDYCCFAAFPRLRTIVQKMPMKLTVNSLKHANDSSSSTEIG 240
            YMSQ+GDLYFANVEE DSRNDYCCFAAFP+LRTIVQKMPMKLTVNS
Sbjct: 181  YMSQRGDLYFANVEENDSRNDYCCFAAFPKLRTIVQKMPMKLTVNS-------------- 226

Query: 241  SKANSIKQRKPKLLLPPTESGSESSITILKGEILLLECFAEGLPTPQVDWNKIGGDLPKG 300
              +NSIKQRKPKLLLPP + GS S+ T+LKG+ LLLECFAEGLPTP + W+K G +LP+G
Sbjct: 227  --SNSIKQRKPKLLLPPAQMGSLSAKTVLKGDTLLLECFAEGLPTPHIQWSKPGSELPEG 284

Query: 301  RETKENYGKTLKIENVSYQDKGNYRCTASNFLGTATHDFHVIVEEPPRWTKKPQSAVYST 360
            R T E + KTLKIEN+SYQD+GNYRCTA+N LG A+HDFHV VEEPPRW KKPQSAVYST
Sbjct: 285  RATIEVHEKTLKIENISYQDRGNYRCTANNLLGKASHDFHVTVEEPPRWKKKPQSAVYST 344

Query: 361  GSNGILLCEAEGEPQPTIKWRVNGSPVDNHPFAGDVVFPREISFTNLQPNHTAVYQCEAS 420
            GS+GILLCEAEGEPQPTIKWR+NG P++ HPF GD +FPREISFTNL PNHT VYQCEAS
Sbjct: 345  GSSGILLCEAEGEPQPTIKWRLNGLPIEKHPFPGDFMFPREISFTNLLPNHTGVYQCEAS 404

Query: 421  NVHGTILANANIDVVDVRPLIQTKDGENYATVVGYSAFLHCEFFASPEAVVSWQKVEEVK 480
            N+HGTILANANIDV+DV PLI+TK+ ENYATVVGYSAFLHCE+FASP+A V W+  +E
Sbjct: 405  NIHGTILANANIDVIDVIPLIKTKNEENYATVVGYSAFLHCEYFASPKATVVWEVADETH 464

Query: 481  PLEGRRYHIYENGTLQINRTTEEDAGSYSCWVENAIGKTAVTANLDIRNATKLRVSPKNP 540
            PLEG RYH +ENGTL+I RTTEEDAGSYSCWV+NA+GK  +TANLDIRNATKLRVSPKNP
Sbjct: 465  PLEGDRYHTHENGTLEIYRTTEEDAGSYSCWVDNAMGKAVITANLDIRNATKLRVSPKNP 524

Query: 541  RIPKLHMLELHCESKCDSHLKHSLKLSWSKDGEAFEINGTEDGRIIIDGANLTISNVTLE 600
            RIPK H+LEL+CES+CDSHLKHSLKLSWSKDGEAFE+NGTEDGRI+IDGA LTISN+T E
Sbjct: 525  RIPKSHVLELYCESQCDSHLKHSLKLSWSKDGEAFEMNGTEDGRIVIDGAYLTISNITAE 584
```

Fig. 4B-2

```
Query: 601  DQGIYCCSAHTALDSAADITQVTVLDVPDPPENLHLSERQNRSVRLTWEAGADHNSNISE 660
            DQG+Y CSA T+LDS +  TQVTVL V DPPE     + +NRSVRL  EAG DHNS  +
Sbjct: 585  DQGVYSCSAQTSLDSTSKKTQVTVLGVGDPPETFTCQKDKNRSVRLLREAGDDHNSKSAS 644

Query: 661  YIVEFEGNKEEPGRWEELTRVQGKKTTVILPLAPFVRYQFRVIAVNEVGRSQPSQPSDHH 720
             IVEFEGN+EEPG+WEELTRVQG++T V+L LAP+VRYQFRV AVNEVGRS  S PSDHH
Sbjct: 645  TIVEFEGNREEPGKWEELTRVQGEETDVVLSLAPYVRYQFRVTAVNEVGRSHASLPSDHH 704

Query: 721  ETPPAAPDRNPQNIRVQASQPKEMIIKWEPLKSMEQNGPGLEYRVTWKPQGAPVEWEEET 780
            ETPPAAPD+NPQNIRVQASQPKEMIIKWEPLKSMEQNGPGLEY+V+WKPQGAP EWEEE
Sbjct: 705  ETPPAAPDKNPQNIRVQASQPKEMIIKWEPLKSMEQNGPGLEYKVSWKPQGAPEEWEEEI 764

Query: 781  VTNHTLRVMTPAVYAPYDVKVQAINQLGSGPDPQSVTLYSGEDYPDTAPVIHGVDVINST 840
            VTNHTLRVMTP VYAPYDVKVQAINQLGS PDPQ VTLYSGEDYP TAPVI  VDV+NST
Sbjct: 765  VTNHTLRVMTPTVYAPYDVKVQAINQLGSSPDPQPVTLYSGEDYPSTAPVIQRVDVMNST 824

Query: 841  LVKVTWSTVPKDRVHGRLKGYQINWWKTKSLLDGRTHPKEVNILRFSGQRNSGMVPSLDA 900
            LVKVTWS++PK+ VHG L+GYQINWWKTKSLLDGRTHPKEVNILRFSGQRNSGMVPSLD
Sbjct: 825  LVKVTWSSIPKETVHGLLRGYQINWWKTKSLLDGRTHPKEVNILRFSGQRNSGMVPSLDP 884

Query: 901  FSEFHLTVLAYNSKGAGPESEPYIFQTPEGVPEQPTFLKVIKVDKDTATLSWGLPKKLNG 960
            FSEFHLTVLAYNSKGAGPESEPYIFQTPEGVPEQP+FLKVIKVDKDTATLSWGLPKKLNG
Sbjct: 885  FSEFHLTVLAYNSKGAGPESEPYIFQTPEGVPEQPSFLKVIKVDKDTATLSWGLPKKLNG 944

Query: 961  NLTGYLLQYQIINDTYEIGELNDINITTPSKPSWHLSNLNATTKYKFYLRACTSQGCGKP 1020
            NLTGYLLQYQIINDTYE+GELN+IN+TTPSK SWHLSNLN+TTKYKFYLRACTS+GCGKP
Sbjct: 945  NLTGYLLQYQIINDTYELGELNEINVTTPSKSSWHLSNLNSTTKYKFYLRACTSRGCGKP 1004

Query: 1021 ITEESSTLGEGSKGIGKIS-GVNLTQKTHPIEVFEPGAEHIVRLMTKNWGDNDSIFQDVI 1079
            I+EE +TLGEGSKGI KI+ GVN+TQK HP+EV  PGAEHIV LMTKNWGDNDSIFQDVI
Sbjct: 1005 ISEEGATLGEGSKGIRKITEGVNVTQKIHPVEVLVPGAEHIVHLMTKNWGDNDSIFQDVI 1064

Query: 1080 ETRGREYAGLYDDISTQGWFIGLMCAIALLTLLLLTVCFVKRNRGGKYSVKEKEDLHPDP 1139
            ETRGREYAGLYDDISTQGWFIGLMCAIALLTL+LLT+CFVKRNRGGKYSVKEKEDLHPDP
Sbjct: 1065 ETRGREYAGLYDDISTQGWFIGLMCAIALLTLILLTICFVKRNRGGKYSVKEKEDLHPDP 1124

Query: 1140 EIQSVKDETFGEYSDSDEKPLKGSLRSLNRDMQPTESADSLVEYGEGDHGLFSEDGSFIG 1199
            E+QS KDETFGEYSDSDEKPLKGSLRSLNR+MQPTESADSLVEYGEGD  +F+EDGSFIG
Sbjct: 1125 EVQSAKDETFGEYSDSDEKPLKGSLRSLNRNMQPTESADSLVEYGEGDQSIFNEDGSFIG 1184

Query: 1200 AYAGSKEKGSVESNGSSTATFPLRA 1224
            AY G+KEKGSVESNGSSTATFPLRA
Sbjct: 1185 AYTGAKEKGSVESNGSSTATFPLRA 1209
```

Fig. 5a: 282P1G3 variant 1
Hydrophilicity profile
(Hopp T.P., Woods K.R., 1981. Proc. Natl. Acad. Sci. U.S.A. 78:3824-3828)
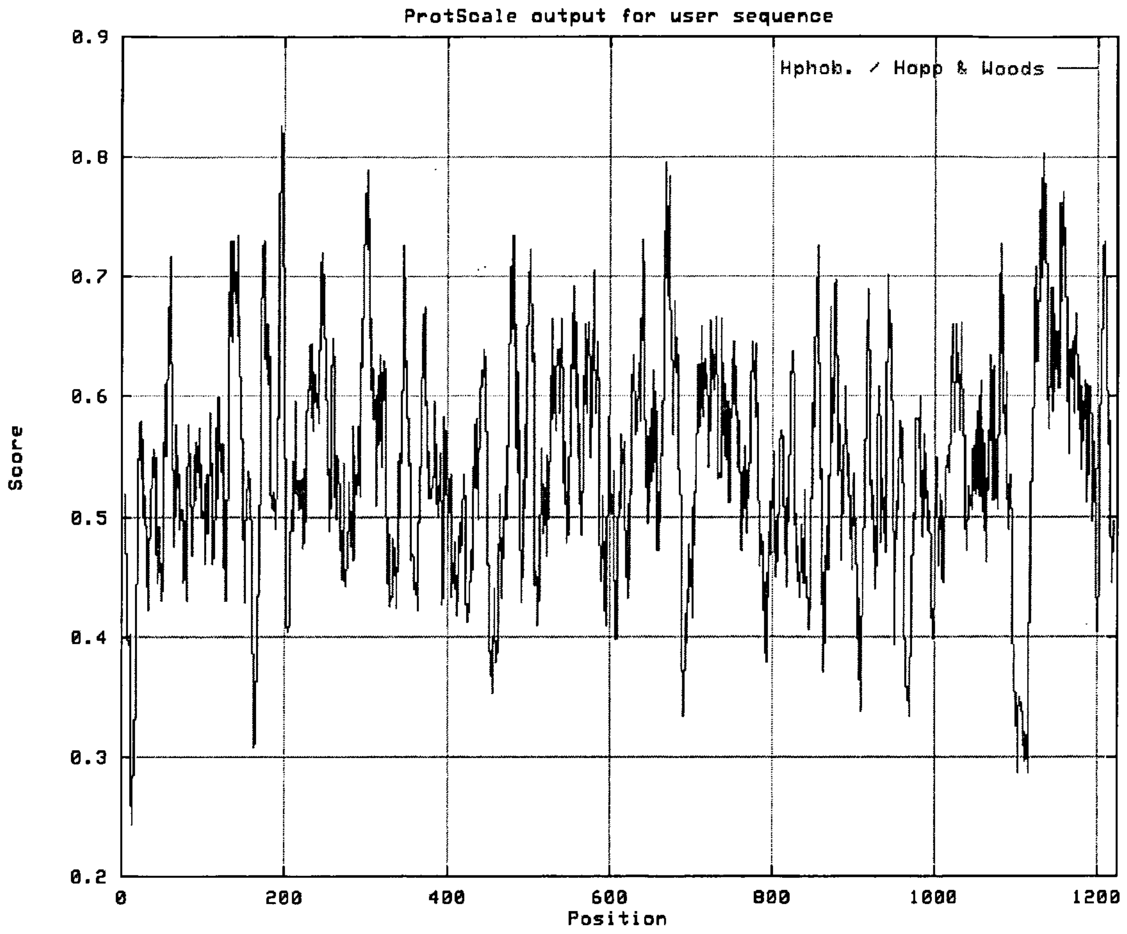

Fig. 5b: 282P1G3 variant 3
Hydrophilicity profile
(Hopp T.P., Woods K.R., 1981.
Proc. Natl. Acad. Sci. U.S.A. 78:3824-3828)
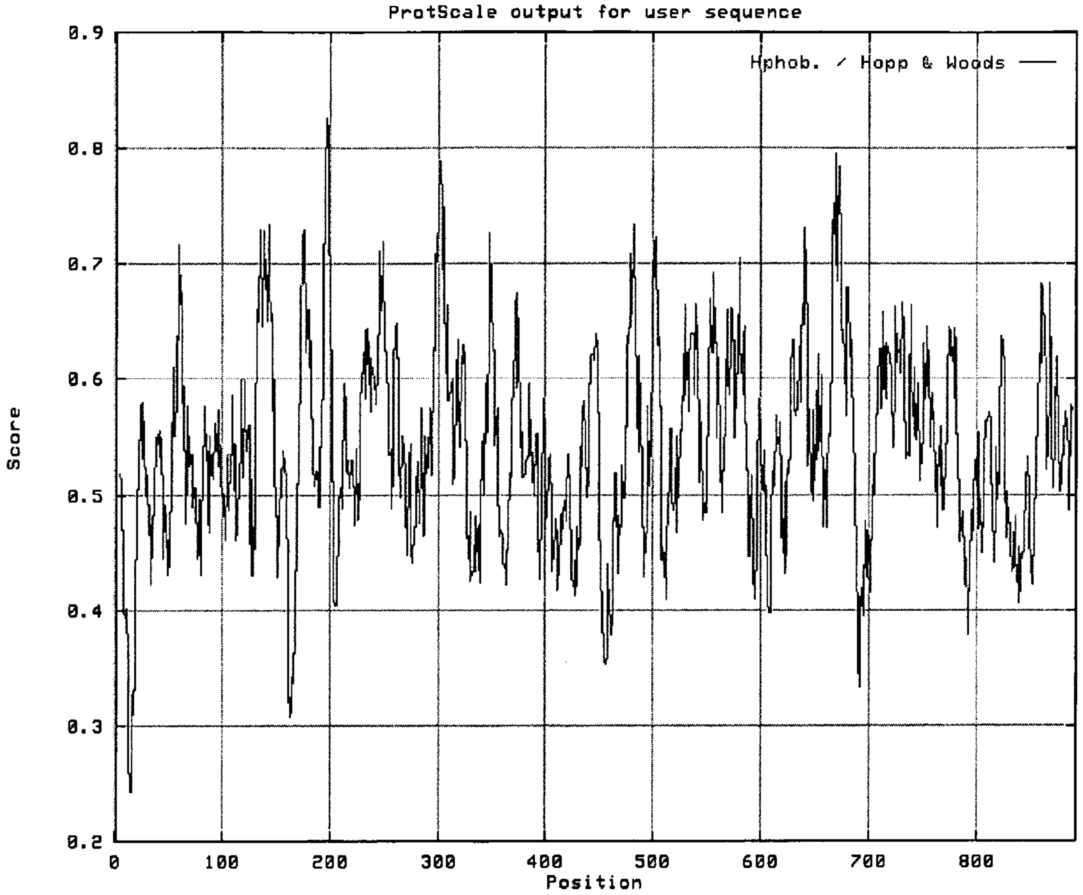

Fig. 5c: 282P1G3 variant 7
Hydrophilicity profile
(Hopp T.P., Woods K.R., 1981.
Proc. Natl. Acad. Sci. U.S.A. 78:3824-3828)
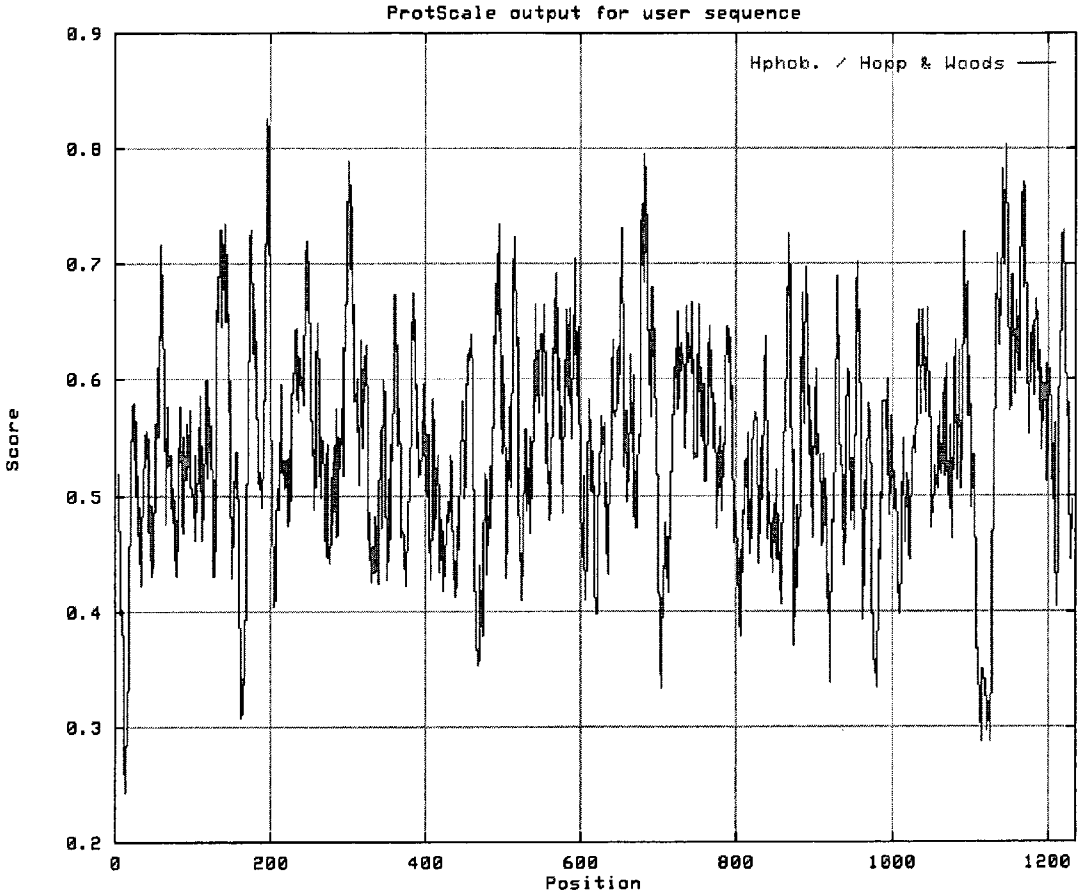

Fig. 6a: 282P1G3 variant 1
Hydropathicity Profile
(Kyte J., Doolittle R.F., 1982. J. Mol. Biol. 157:105-132)
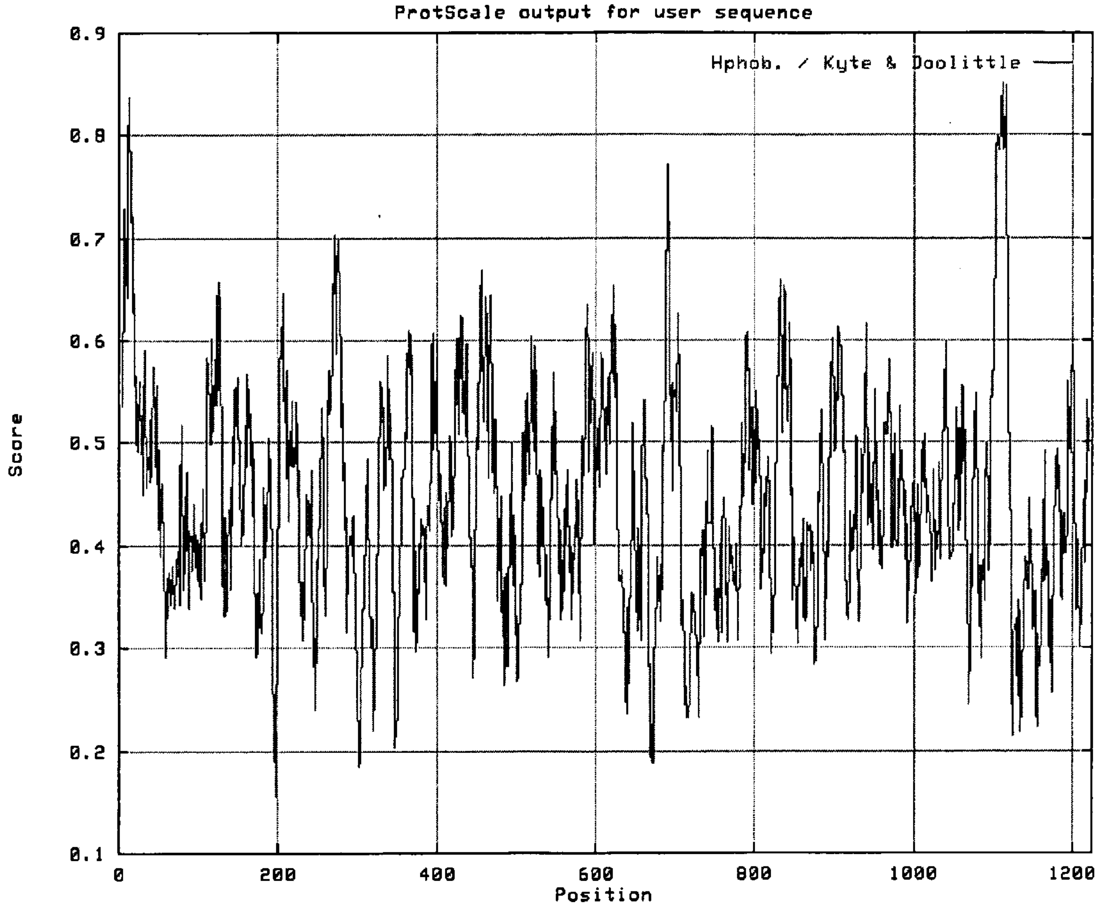

Fig. 6b: 282P1G3 variant 3
Hydropathicity Profile
(Kyte J., Doolittle R.F., 1982. J. Mol. Biol. 157:105-132)
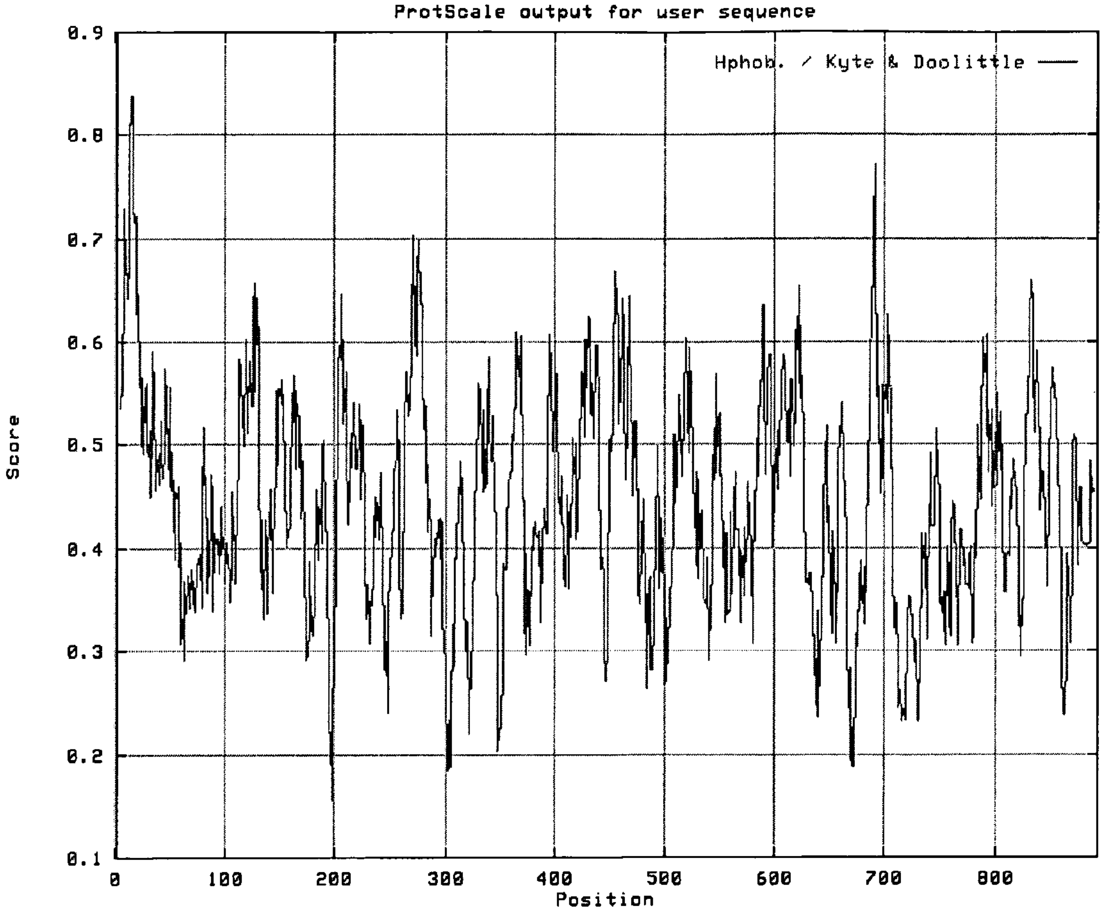

Fig. 6c: 282P1G3 variant 7
Hydropathicity Profile
(Kyte J., Doolittle R.F., 1982. J. Mol. Biol. 157:105-132)
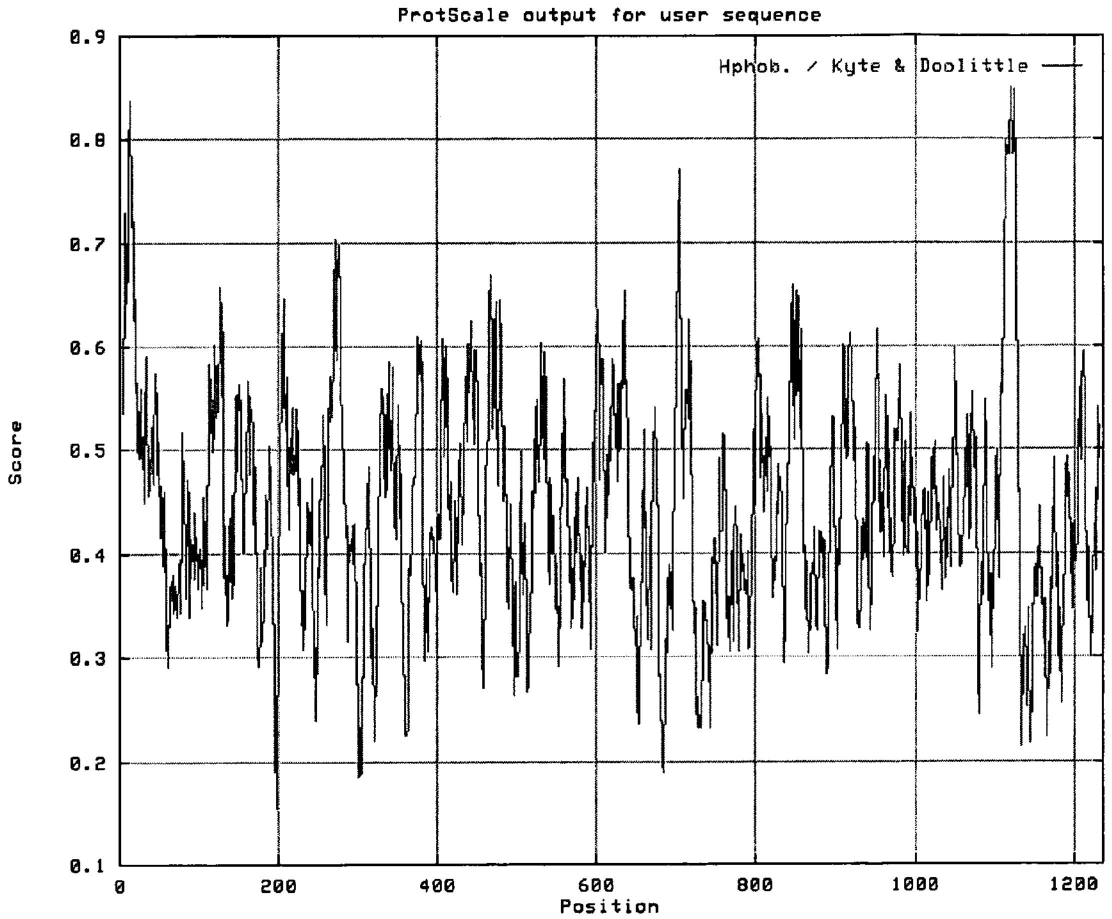

Fig. 7a: 282P1G3 variant 1 % Accessible Residues Profile
(Janin J., 1979. Nature 277:491-492)
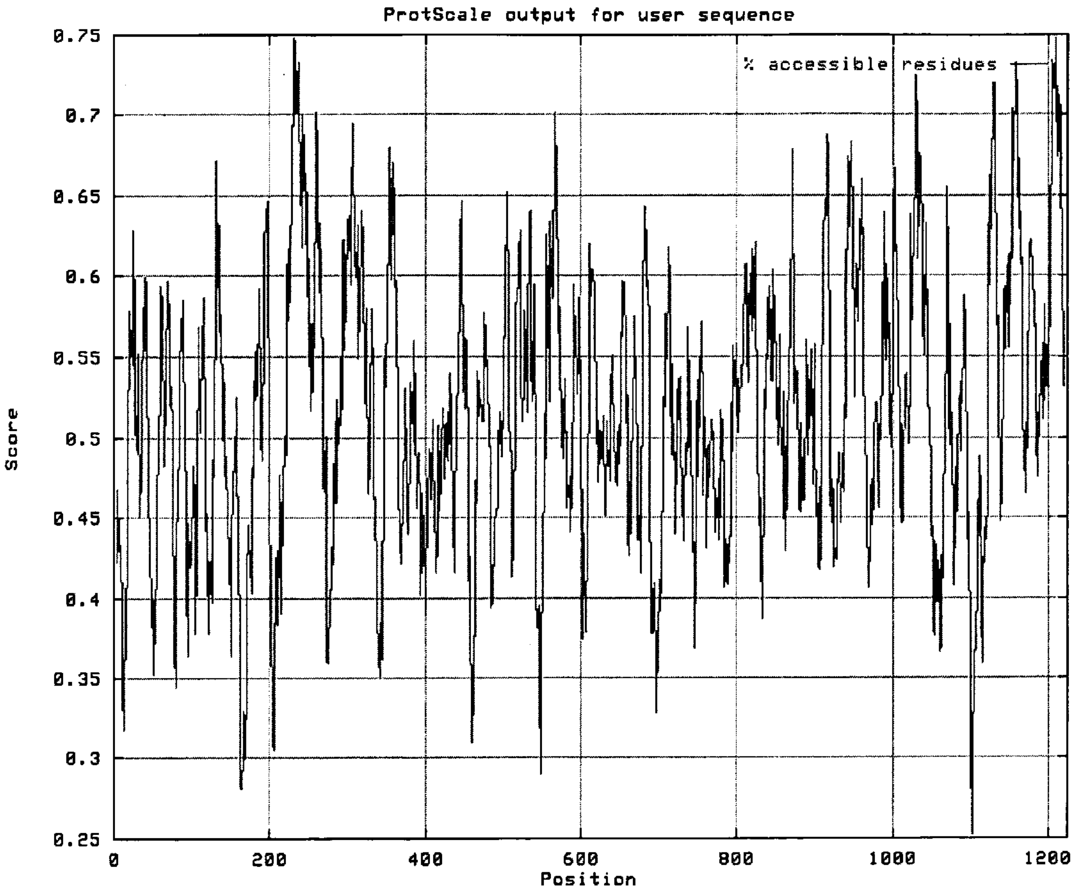

Fig. 7b: 282P1G3 variant 3 % Accessible Residues Profile
(Janin J., 1979. Nature 277:491-492)
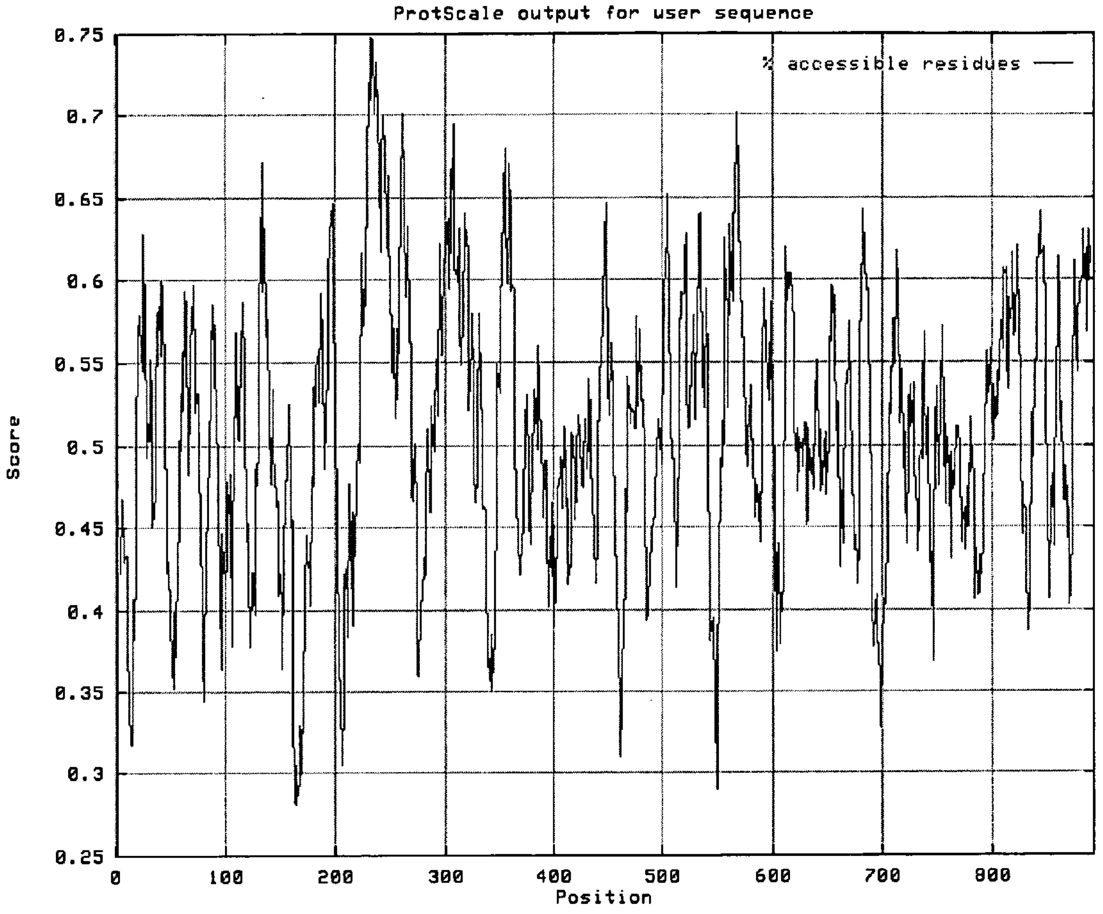

Fig. 7c: 282P1G3 variant 7 %
Accessible Residues Profile
(Janin J., 1979. Nature 277:491-492)
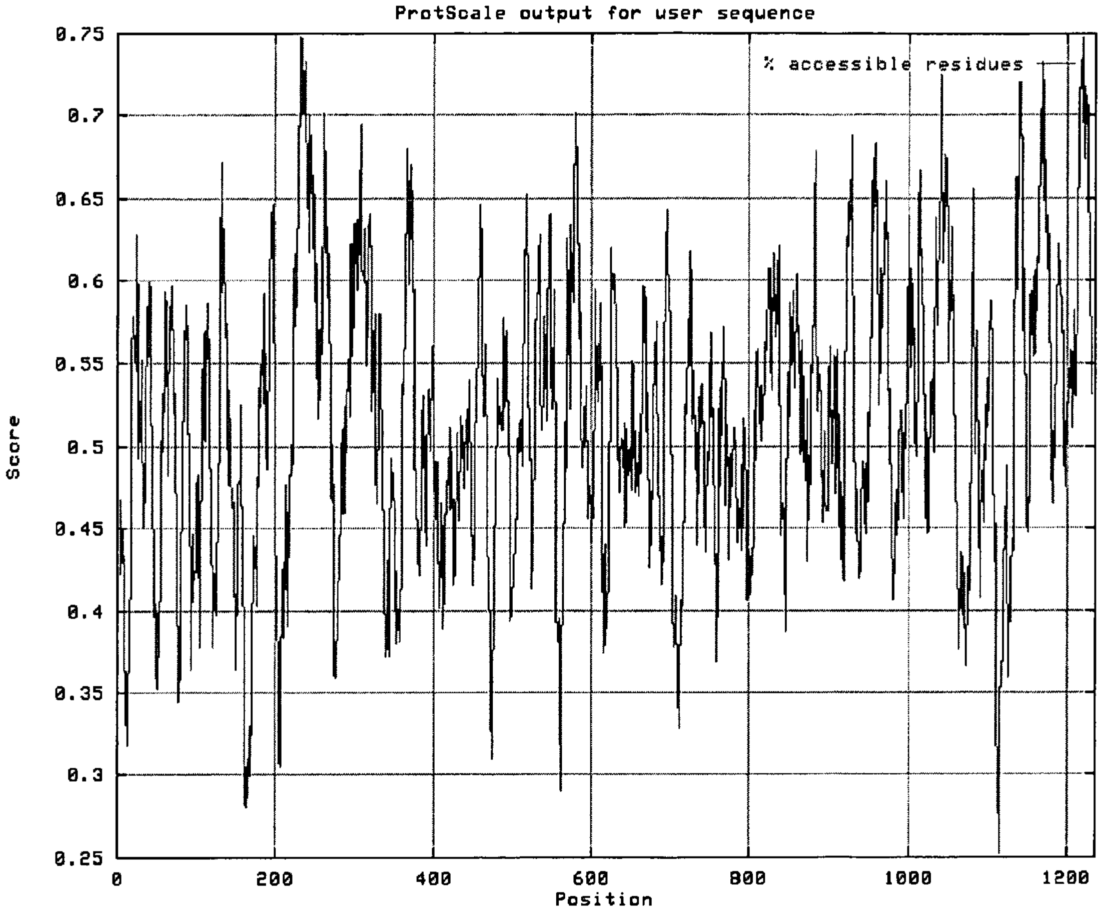

Fig. 8a: 282P1G3 variant 1
Average Flexibility Profile
(Bhaskaran R., Ponnuswamy P.K., 1988.
Int. J. Pept. Protein Res. 32:242-255)
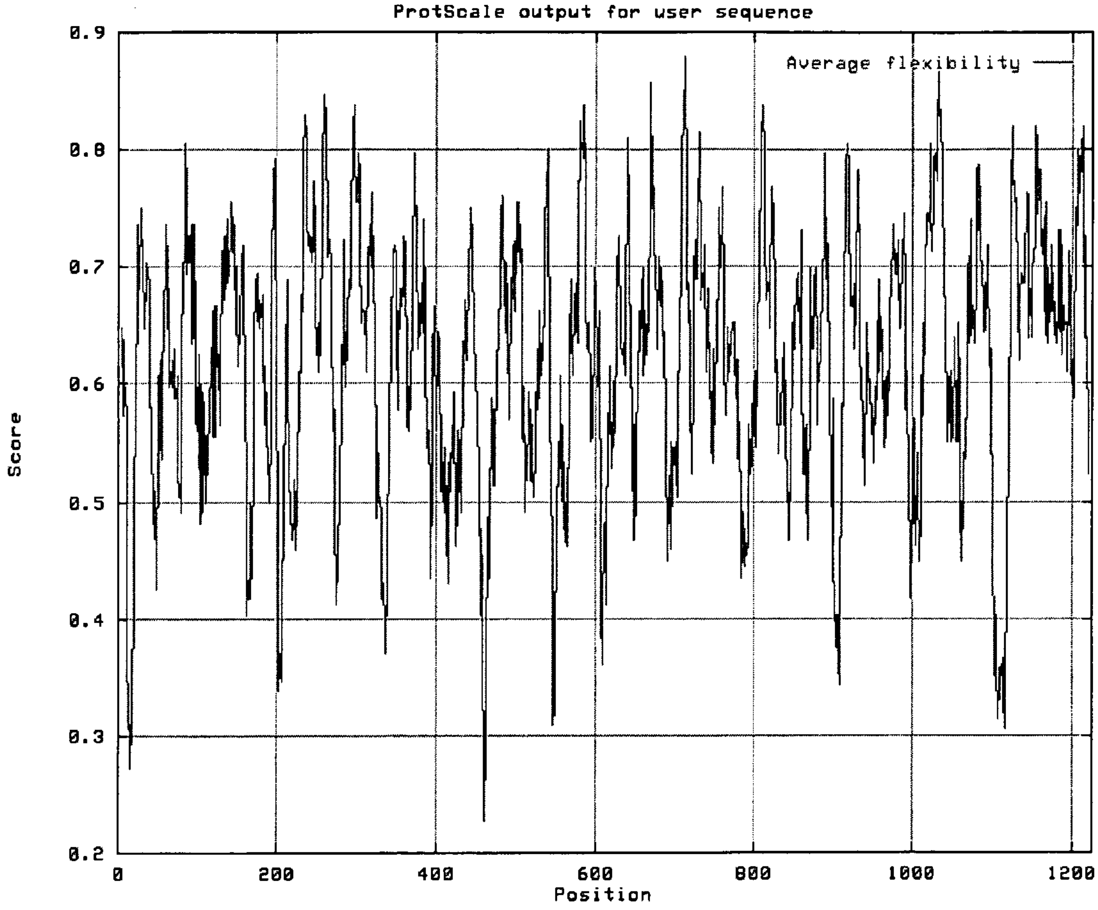

Fig. 8b: 282P1G3 variant 3
Average Flexibility Profile
(Bhaskaran R., Ponnuswamy P.K., 1988.
Int. J. Pept. Protein Res. 32:242-255)
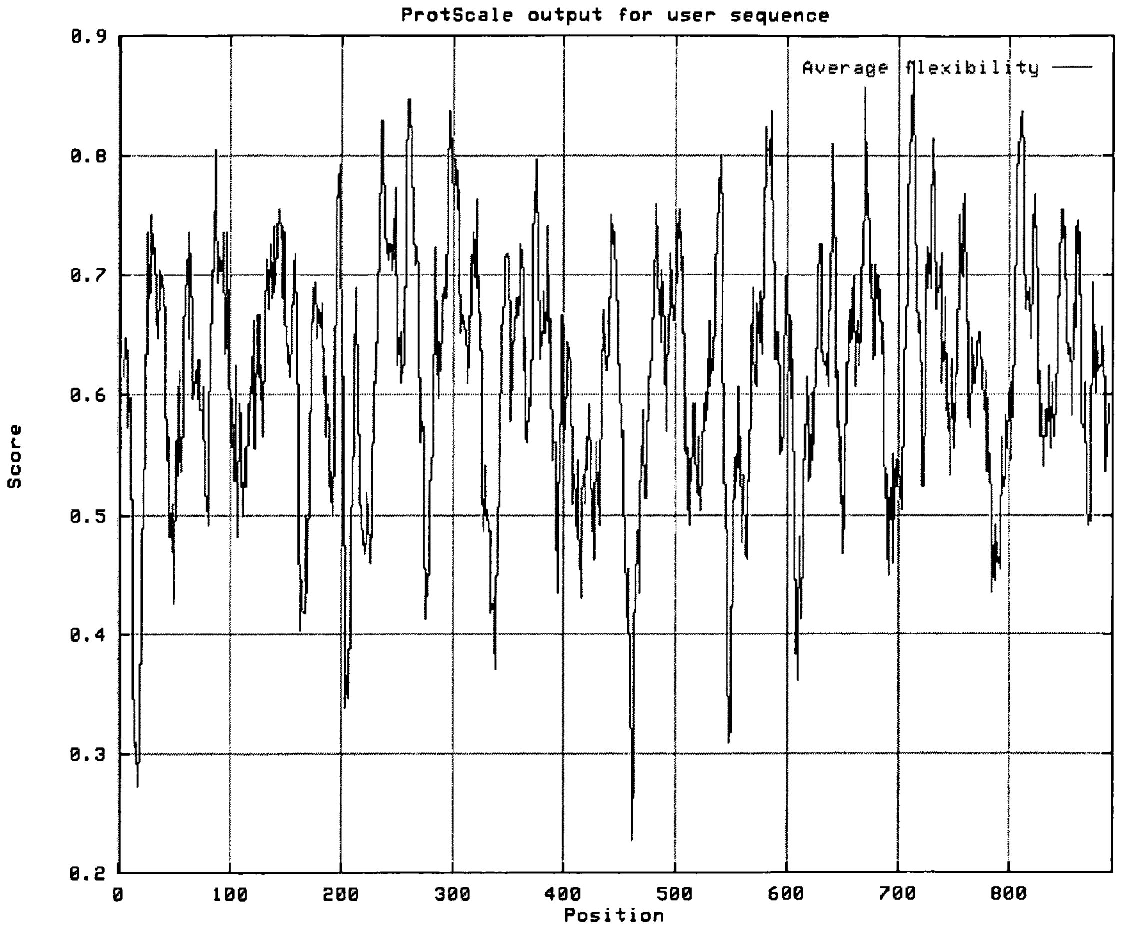

Fig. 8c: 282P1G3 variant 7
Average Flexibility Profile
(Bhaskaran R., Ponnuswamy P.K., 1988.
Int. J. Pept. Protein Res. 32:242-255)
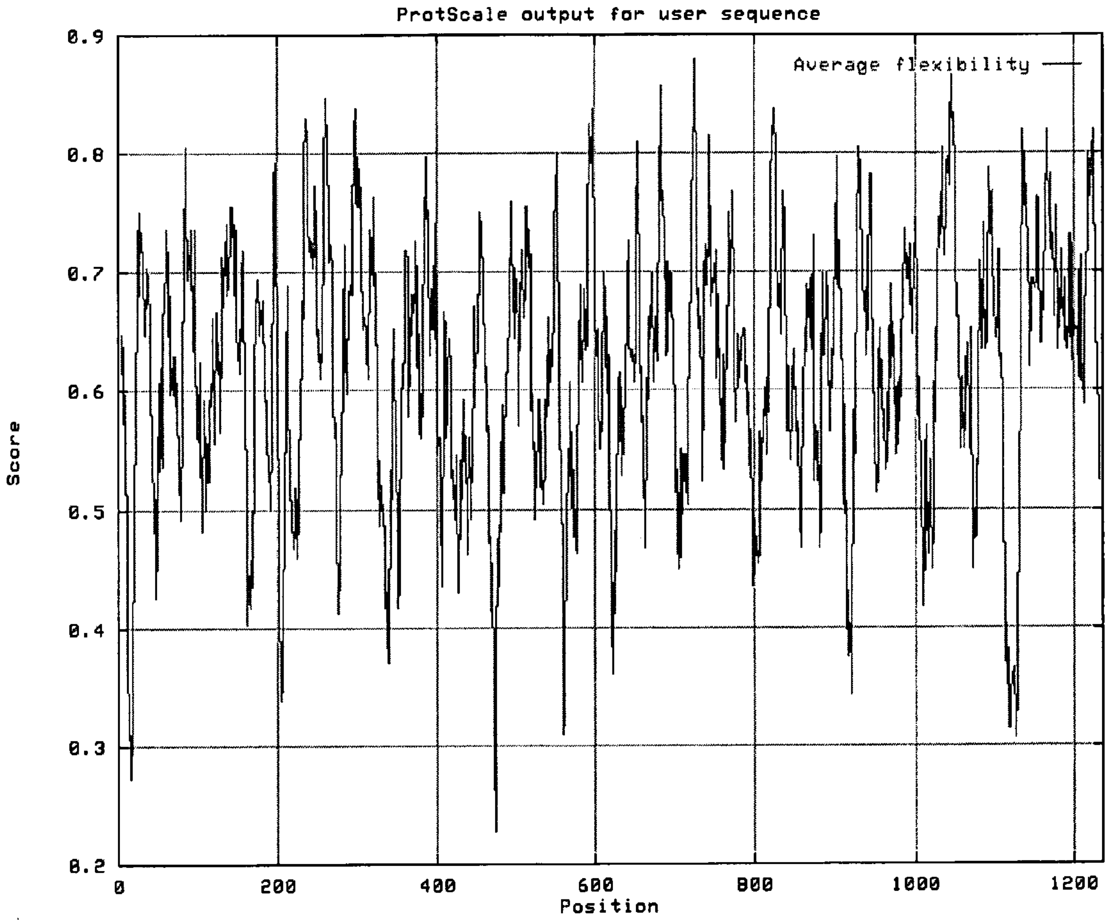

Fig. 9a: 282P1G3 variant 1
Beta-turn Profile
(Deleage, G., Roux B. 1987. Protein Engineering 1:289-294)
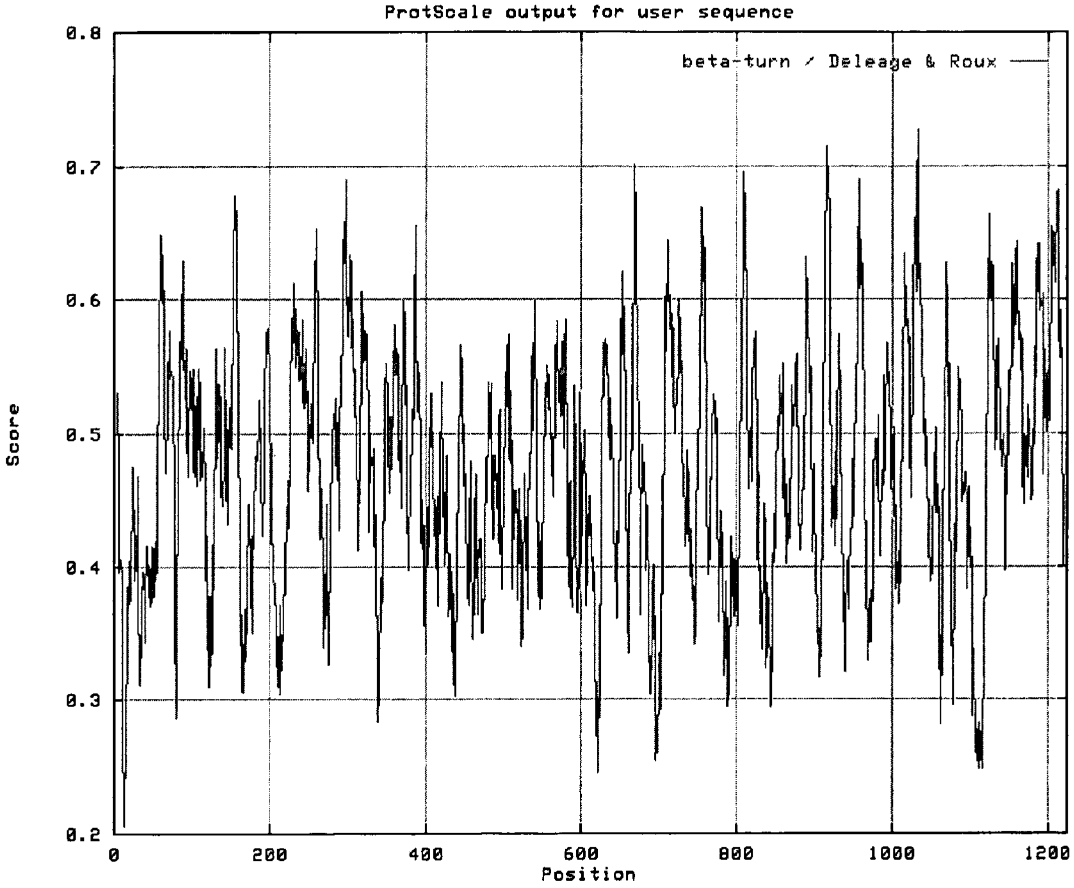

Fig. 9b: 282P1G3 variant 3
Beta-turn Profile
(Deleage, G., Roux B. 1987.
Protein Engineering 1:289-294)
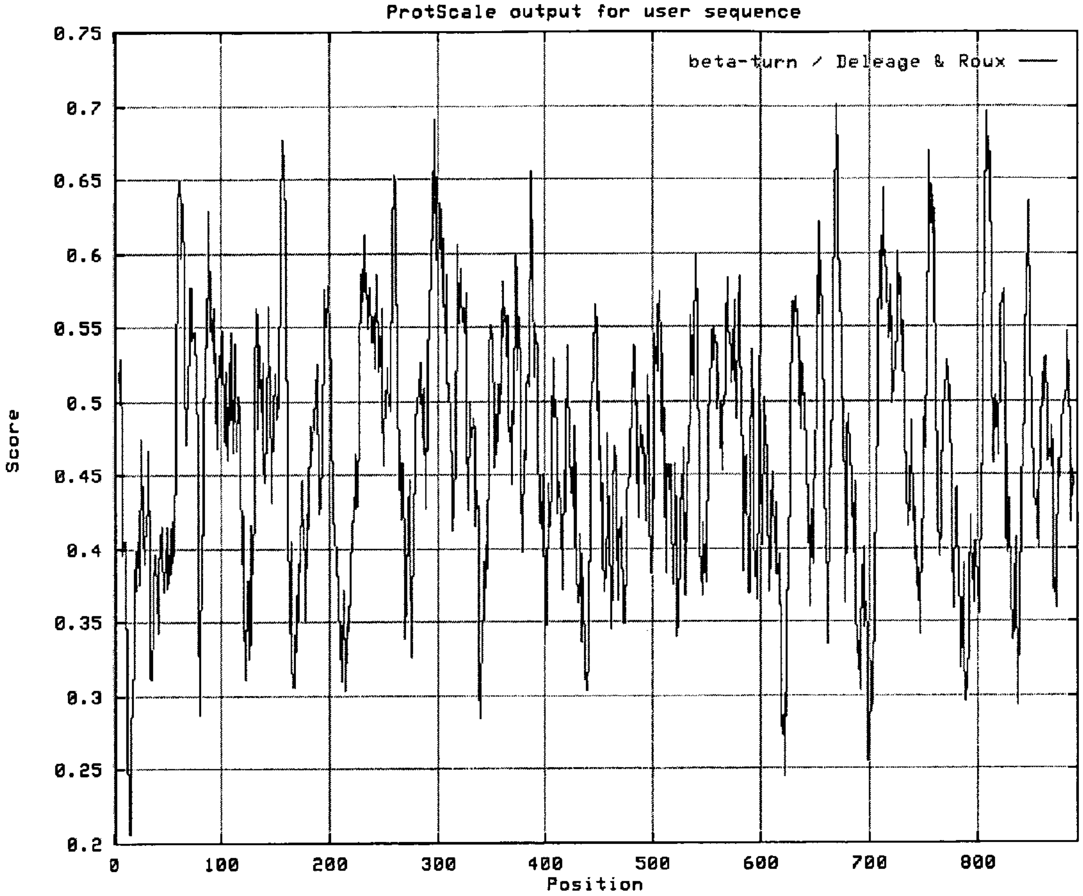

Fig. 9c: 282P1G3 variant 7
Beta-turn Profile
(Deleage, G., Roux B. 1987.
Protein Engineering 1:289-294)
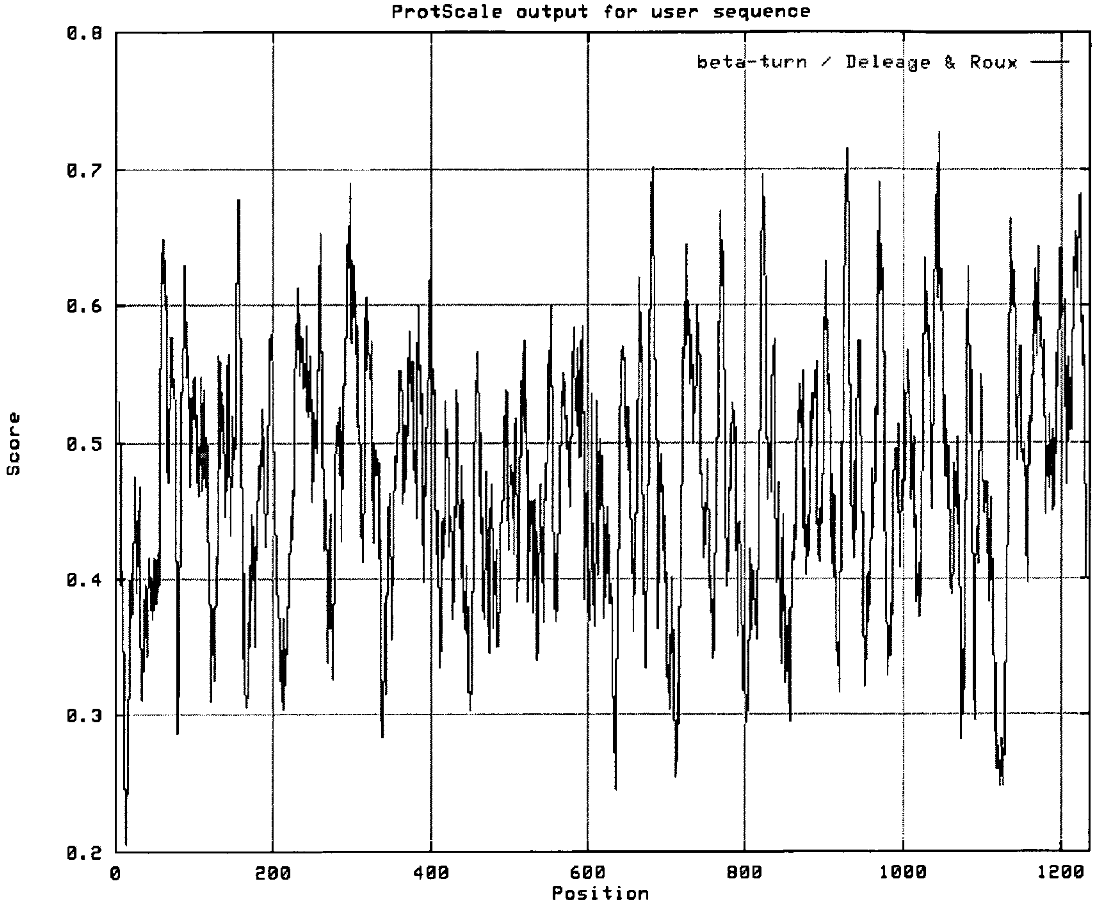

Fig.13A

Secondary structure prediction of 282P1G3B variant 1

```
        10        20        30        40        50        60        70        80        90       100
         |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhcheeeccccchccheeeecceeeeccccchheeehhhcccccccceeccccccceeecccceeecccccccceecccccccc
SHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRN
chccccchehhcccccceeeeccceeeeeccccccccccccceccccccceeeccccccccccceeeeeeechhhhchcceeeheccccceeeeeecccccc
DYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKG
cccehhhhhchhhhhhcccceeeecccccccccccccccchchcchccccceecccccccccchhehhhhhhhhhhhhhccccccchchccccccc
RETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPR
ccccccccceeeeeeeecccccccceeeccccccccccccceeeeecccccccccccccceeeecccceeeeeeeccccccceeeeeecccccccccccccccccc
EISFTNLQPNHTAVYQCEASNVHGTILANANIDVVDVRPLIQTKDGENYATVVGYSAFLHCEFFASPEAVVSWQKVEEVKPLEGRRYHIYENGTLQINRT
eeeecccccccceeeeecccccccceeeecccceeeeecccceeeecccccceeeeeeeeeeeeeeecccccchheehhhhhhccccccceeeeeeeccceeeeecc
TEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLE
ccccccccchehhcccccchhhhhhhchccccceeeecccccccccccceeeeecccccccccccccceeeeeeeccccceeeecccccceeeeecccceeeeeeeec
DQGIYCCSAHTALDSAADITQVTVLDVPDPPENLHLSERQNRSVRLTWEAGADHNSNISEYIVEFEGNKEEPGRWEELTRVQGKKTTVILPLAPFVRYQF
ccceeeecccccchcccccceeeeeeeeccccccccccccecccccccccceeeeeeccccccccchheeeeeccccccccchhhhhhccccceeeeeeccchhhhhhe
RVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVK
eeeehcccccccccccccccccccccccccccccceeeeccccceeeeeecccccccccccccceeeeeeeccccccccchhhcccceeeeeeccccccchhhh
VQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDA
hhhhhhhcccccccceeeeeecccccccccceeecceehhccceeeeeeeeccccccccccccccceeeeeeccccccccccccceeeeeeecccccccccccchh
FSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLN
hhhhhhhhhhhccccccccccceeeecccccccccccceeeeeeecccceeeccccccccccchheeeeehhhccceeeeccccceeeccccccccccccc
ATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFI
cchhhheeeeecccccccccccccccccccccccccceeeeeeeeccccccceeecccchhhhhhhhhhhhcccccchhhhhhhhccccchhhhcchchccchhhh
GLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGA
hhhhhhhhhhhhhhhhhhhhhcccccceeeeccccccccccccccccccccccccccccccccchhhhccccccccccccceeeecccccceeecccccceeee
YAGSKEKGSVESNGSSTATFPLRA
ccccccccceecccccccccccccc
```

Alpha helix (h): 15.77%
Extended strand (e): 26.14%
Random coil (c) : 58.09%

Fig.13B

Secondary structure prediction of 282P1G3B variant 2

```
        10        20        30        40        50        60        70        80        90       100
         |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhcheeeccccchccchheeeecceeeeccccchheeehhhccccccccceeccccceeeccceeeccccccceecccccc
SHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRN
chccccheh hccccceeeecccceeeeecccccccccccccecccccceeeccccccccccccceeeeeeechhhhchcceeeheccccceeeeeeccccccc
DYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKG
cccehhhhhchhhhhhccccceeeecccccccccccccccchchcchccccccceeccccccccccchhehhhhhhhhhhhhhhccccccchccccccccc
REAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPR
chhhhccccceeeeeeeeccccccceeeccccccccccccceeeeecccccccccccccceeeeccccceeeeeeccccccceeeeeeccccccccccccccccc
EISFTNLQPNHTAVYQCEASNVHGTILANANIDVVDVRPLIQTKDGENYATVVGYSAFLHCEFFASPEAVVSWQKVEEVKPLEGRRYHIYENGTLQINRT
eeeecccccccceeeeeccccccceeeecccceeeeecccceeeecccccceeeeeeeeeeeeeeecccccchheehhhhhhccccccceeeeeecccceeeecc
TEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLE
cccccccccchehhccccchhhhhhhchccccceeeecccccccccccceeeeecccccccccccccceeeeeeccccceeeeccccccceeeeecccceeeeeeeeeec
DQGIYCCSAHTALDSAADITQVTVLDVPDPPENLHLSERQNRSVRLTWEAGADHNSNISEYIVEFEGNKEEPGRWEELTRVQGKKTTVILPLAPFVRYQF
ccceeeecccccchcccccceeeeeeeccccccccccecccccccceeeeeeccccccccchheeeeeccccccccchhhhhhccccceeeeeecchhhhhhe
RVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVK
eeeeehcccccccccccccccccccccccccccceeeecccccceeeeeeccccccccccccceeeeeeeccccccccccchhhccccceeeeeecccccccchhhh
VQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDA
hhhhhhhcccccccceeeeeeccccccccccceeeccehhccceeeeeeeeccccccccccccccceeeeeecccccccccccccceeeeeeccccccccccccccchh
FSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLN
hhhhhhhhhhhcccccccccccceeeecccccccccccceeeeeeeccccceeeccccccccccccchheeeeehhhccceeeecccceeeccccccccccccccc
ATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYS
cchhhheeeeeccccccccccccccccccccccccchhchcchhhhhhhhhhhhhhhhhhhhhhhhhcccccceeeecccccccccccccccccccccccc
DSDEKPLKGSLRSLNRDMQPTESADSLVEYGEGDHGLFSEDGSFIGAYAGSKEKGSVESNGSSTATFPLRA
cccccccccchhhhcccccccccccceeeeccccceeeccccceeeeccccccccceecccccccccccccccc
```

Alpha helix (h): 14.86%
Extended strand (e): 26.39%
Random coil (c) : 58.75%

Fig. 13C

Secondary structure prediction of 282P1G3B variant 3

```
10        20        30        40        50        60        70        80        90        100
|         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhhcheeeccccchccheeeecceeeeccccchheeehhhcccccccccceecccccceeeccceeeccccccccceecccccccc
SHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRN
chccccchehhccccceeeecccceeeeecccccccccccceccccccceeecccccccccccccceeeeeeechhhhchcceeeheccccceeeeeecccccccc
DYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKG
cccehhhhhchhhhhhcccceeeeccccccccccccccchchcchccccccceecccccccccccchhehhhhhhhhhhhhhhccccccchchcccccccc
RETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPR
cccccccccceeeeeeeeeccccccceeeccccccccccccceeeeeccccccccccccceeeecccceeeeeeecccccccceeeeeecccccccccccccccccccc
EISFTNLQPNHTAVYQCEASNVHGTILANANIDVVDVRPLIQTKDGENYATVVGYSAFLHCEFFASPEAVVSWQKVEEVKPLEGRRYHIYENGTLQINRT
eeeeccccccccceeeeeeccccccceeeecccceeeeeecccceeeeeccccceeeeeeeeeeeeeeeecccccchheehhhhhhccccccceeeeeeccceeeecc
TEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLE
ccccccccchehhcccccchhhhhhhchccccceeeeccccccccccceeeeeecccccccccccceeeeeecccccceeeeccccccceeeeeecccceeeeeeeeec
DQGIYCCSAHTALDSAADITQVTVLDVPDPPENLHLSERQNRSVRLTWEAGADHNSNISEYIVEFEGNKEEPGRWEELTRVQGKKTTVILPLAPFVRYQF
ccceeeeccccchcccccceeeeeeecccccccccceccccccccceeeeeecccccccccchheeeeecccccccccchhhhhhcccccceeeeeecccchhhhhhe
RVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVK
eeeeehcccccccccccccccccccccccccceeeecccccceeeeeecccccccccccccccceeeeeeecccccccccchhhccccceeeeeecccccccchhhh
VQAINQLGSGPDPQSVTLYSGEDYPDTAPVIHGVDVINTTYVSNATGSPQPSIFICSKEQELSYRNRNMLAEDFIQKSTSCNYVEKSSTFFKI
hhhhhhhcccccccceeeeeeccccccccccceeeeeeeeeeeeeeccccccccceeeeeccccccccccccchhhhhhhhhcccccccceeeccccceecc
```

Alpha helix (h): 14.00%
Extended strand (e):29.34%
Random coil (c) : 56.66%

Fig.13D

Secondary structure prediction of 282P1G3B variant 4

```
         10        20        30        40        50        60        70        80        90       100
          |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhcheeecccccchcccheeeecceeeeccccchheeehhhcccccccccceecccccceeeccceeecccccccceecccccccc
SHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRN
chccccchehhcccccceeeecccceeeeecccccccccccccecccccceeecccccccccccceeeeeeechhhhchcceeeheccccceeeeeecccccc
DYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKG
cccehhhhhchhhhhhcccceeeecccccccccccccchchcchccccccceeccccccccccchhehhhhhhhhhhhhhcccccccchchcccccccc
RETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPR
cccccccccceeeeeeeeecccccccceeeccccccccccccceeeeeccccccccccccceeeeecccceeeeeeecccccccceeeeeeccccccccccccccccccc
EISFTNLQPNHTAVYQCEASNVHGTILANANIDVVDVRPLIQTKDGENYATVVGYSAFLHCEFFASPEAVVSWQKVEEVKPLEGRRYHIYENGTLQINRT
eeeeccccccccceeeeeccccccceeeeccceeeeecccceeeecccccceeeeeeeeeeeeeeeeccccchheehhhhhhccccccceeeeeeecccceeeecc
TEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLE
ccccccccchehhcccccchhhhhhchccccceeeecccccccccccceeeeeccccccccccccceeeeeecccccceeeeccccccceeeeeeccceeeeeeeeec
DQGIYCCSAHTALDSAADITQVTVLDVPDPPENLHLSERQNRSVRLTWEAGADHNSNISEYIVEFEGNKEEPGRWEELTRVQGKKTTVILPLAPFVRYQF
ccceeeeccccchcccccceeeeeeecccccccccecccccccceeeeeecccccccccchheeeeeccccccccchhhhhhccccceeeeeecccchhhhhhe
RVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVK
eeeeehcccccccccccccccccccccccccceeeecccccceeeeeeecccccccccccccceeeeeeeeccccccccccchhhccccceeeeeeccccccchhhh
VQAINQLGSGPDPQSVTLYSGEDLPEQPTFLKVIKVDKDTATLSWGLPKKLNGNLTGYLLQYQIINDTYEIGELNDINITTPSKPSWHLSNLNATTKYKF
hhhhhhhcccccceeeeeeccccccccccceeeeeeeecccccceeeccccccccccchheeeeehhhcccceeeeecccceeecccccccccccccccchhhhe
YLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIA
eeeecccccccccccccccccccccccceeeeeeeeeeccccccceeecccchhhhhhhhhhhccccccchhhhhhhhccccchhhhcchchcccchhhhhhhhhhh
LLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEK
hhhhhhhhhhhhhccccccceeeecccccccccccccccccccccccccccccccccccccchhhhcccccccccccceeeecccccceeecccccceeeecccccccc
GSVESNGSSTATFPLRA
ceecccccccccccccc
```

Alpha helix (h): 15.94%
Extended strand (e): 26.14%
Random coil (c) : 57.92%

Fig.13E

Secondary structure prediction of 282P1G3B variant 5

```
        10        20        30        40        50        60        70        80        90       100
         |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhhcheeeccccchccchеeeecceeeeeccccchheeehhhccccccccceecccccceeeccceeeccccccccceecccccccc
SHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRN
chccccchehhccccceeeeccceeeeecccccccccccccccecccccceeeccccccccccccceeeeeeechhhhchcceeeheccccceeeeeeeccccccc
DYCCFAAFPRLRTIVQKMPMKLTVNSSNSIKQRKPKLLLPPTESGSESSITILKGEILLLECFAEGLPTPQVDWNKIGGDLPKGRETKENYGKTLKIENV
cccehhhhhchhhhhhccccceeeecccccccccccccccccccccccchhehhhhhhhhhhhhhcccccccchchccccccccccccccccceeeeeee
SYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQ
eccccccceeeccccccccccceeeeecccccccccccceeeecccceeeeeecccccccceeeeeeccccccccccccccccceeeeccccccccceeee
CEASNVHGTILANANIDVVDVRPLIQTKDGENYATVVGYSAFLHCEFFASPEAVVSWQKVEEVKPLEGRRYHIYENGTLQINRTTEEDAGSYSCWVENAI
eccccccceeeecccceeeeecccceeeecccccceeeeeeeeeeeeeeecccccchheehhhhhhcccccccceeeeeecccceeeeccccccccccchehhccc
GKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSA
cchhhhhhhchccccceeeecccccccccceeeeeccccccccccccceeeeeeccccceeeeccccccceeeeeccceeeeeeeeeecccceeeeecccchccc
ADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQP
ccceeeeeeeccccccccceccccccccceeeeeecccccccccchheeeeeecccccccccchhhhhhcccccceeeeeecccchhhhhheeeeeehcccccccccc
SDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSV
ccccccccccccccccceeeeccccceeeeeecccccccccccceeeeeeecccccccccchhhccccceeeeeccccccchhhhhhhhhhcccccccee
TLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGA
eeeccccccccceeeccehhccceeeeeeecccccccccccccceeeeeeccccccccccccceeeeeecccccccccccchhhhhhhhhhhhccccc
GPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQG
cccccceeeeccccccccccceeeeeeeccccceeecccccccccccchheeeeehhhccceeeeeccccceeeccccccccccccccccccchhhheeeeeecccc
CGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTV
ccccccccccccccccccceeeeeeeeccccccceeeccchhhhhhhhhhhcccccchhhhhhhhccccchhhhcchchccchhhhhhhhhhhhhhhhhhh
CFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSS
hhhhccccceeeeccccccccccccccccccccccccccccccchhhhcccccccccccceeeeccccceeecccccceeeeccccccccceeccccccc
TATFPLRA
cccccccc
```

Alpha helix (h): 15.73%
Extended strand (e): 26.32%
Random coil (c) : 57.95%

Fig. 13F

Secondary structure prediction of 282P1G3B variant 6

```
        10        20        30        40        50        60        70        80        90       100
         |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhcheeeccccchccccheeeecceeeeeccccchheeehhhccccccccceeccccccceeeccceeecccccccceecccccccc
SHFQGKYRCFASNKLGIAMSEEIEFIVPKLEHIEQDERVYMSQKGDLYFANVEEKDSRNDYCCFAAFPRLRTIVQKMPMKLTVNSLKHANDSSSSTEIGS
chccccchehhcccccceehhhhhhhhcccccccchhhheehhccccceeeeeecccccccccccehhhhhchhhhhhcccceeeeccccccccccccccch
KANSIKQRKPKLLLPPTESGSESSITILKGEILLLECFAEGLPTPQVDWNKIGGDLPKGRETKENYGKTLKIENVSYQDKGNYRCTASNFLGTATHDFHV
chcchcccccceeccccccccccchhehhhhhhhhhhhhhcccccccchchccccccccccccccccccceeeeeeeeccccccceeecccccccccccccceee
IVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLI
eeccccccccccccceeeeccccceeeeeeccccccceeeeeecccccccccccccccccccceeeecccccccccceeeeecccccccceeeecccceeeeeecccee
QTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPR
eeccccceeeeeeeeeeeeeeeeccccccchheehhhhhhccccccceeeeeecccceeeeccccccccccccchehhcccccchhhhhhchccccceeeeeccccccc
IPKLHMLELHCESKCDSHLKHSLKLSWSKDGEAFEINGTEDGRIIIDGANLTISNVTLEDQGIYCCSAHTALDSAADITQVTVLDVPDPPENLHLSERQN
ccccceeeeeeccccccccccccceeeeeeccccceeeeccccccceeeeeccceeeeeeeeeeccccceeeecccccchcccccceeeeeeeccccccccceccccc
RSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQP
cceeeeeeecccccccccchheeeeeccccccccccchhhhhhccccceeeeeecccchhhhhhheeeeeehcccccccccccccccccccccccccccceeeeecccc
KEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTL
ceeeeeecccccccccccccccceeeeeeeeccccccccccchhhcccceeeeeecccccchhhhhhhhhhhccccccceeeeeeeccccccccceeeccehhccce
VKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVI
eeeeeeccccccccccccccceeeeeeccccccccccccccceeeeeeccccccccccccchhhhhhhhhhhhhccccccccccceeeecccccccccccceeeee
KVDKDTATLSWGLPKKLNGNLTGYLLQYQIINDTYEIGELNDINITTPSKPSWHLSNLNATTKYKFYLRACTSQGCGKPITEESSTLGEGSKGIGKISGV
eecccccceeeccccccccccccchheeeeehhhccceeeeccccceeeccccccccccccccccchhhheeeeeccccccccccccccccccccccccceeeeee
NLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEI
eecccccceeecccchhhhhhhhhhhhcccccchhhhhhhhccccchhhhcchchcccchhhhhhhhhhhhhhhhhhhhhhhhhcccccceeeecccccccccccc
QSVKDETFGEYSDSDEKPLKGSLRSLNRDMQPTESADSLVEYGEGDHGLFSEDGSFIGAYAGSKEKGSVESNGSSTATFPLRA
ccccccccccccccccccccchhhhccccccccccccceeeeccccceeecccccceeeeccccccccceecccccccccccccccc
```

Alpha helix (h): 16.99%
Extended strand (e): 25.36%
Random coil (c) : 57.65%

Fig.13G

Secondary structure prediction of 282P1G3B variant 7

10 20 30 40 50 60 70 80 90 100

MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhhcheeeccccchccccheeeecceeeeeccccchheeehhhccccccccceeccccccceeecccceeeccccccceecccccc
SHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRN
chccccchehhcccceeeeeccceeeeeeccccccccccccccececcccccceeecccccccccccceeeeeeechhhhchcceeeheccccceeeeeeccccccc
DYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKG
cccehhhhhchhhhhhccccceeeeccccccccccccccchchcchccccccceeccccccccccchhehhhhhhhhhhhhhccccccccchchcccccccc
RETKENYGKTLKIENVSYQDKGNYRCTASNFLGTATHDFHVIVEDNISHELFTLHPEPPRWTKKPQSAVYSTGSNGILLCEAEGEPQPTIKWRVNGSPVD
cccccccccceeeeeeeeecccccccceeecccccccccccccceeeeeccccceeehhcccccccccccccceeeeeccccceeeeeeecccccccceeeeeeecccccc
NHPFAGDVVFPREISFTNLQPNHTAVYQCEASNVHGTILANANIDVVDVRPLIQTKDGENYATVVGYSAFLHCEFFASPEAVVSWQKVEEVKPLEGRRYH
ccccccccccccceeeeccccccccceeeeecccccccceeeeccceeeeecccceeeecccccceeeeeeeeeeeeeeeeccccccchheehhhhhhccccccccceee
IYENGTLQINRTTEEDAGSYSCWVENAIGKTAVTANLDIRNATKLRVSPKNPRIPKLHMLELHCESKCDSHLKHSLKLSWSKDGEAFEINGTEDGRIIID
eeecccceeeecccccccccccchehhccccchhhhhhchcccceeeeccccccccccceeeeeccccccccccccceeeeeecccccceeeecccccccceeeee
GANLTISNVTLEDQGIYCCSAHTALDSAADITQVTVLDVPDPPENLHLSERQNRSVRLTWEAGADHNSNISEYIVEFEGNKEEPGRWEELTRVQGKKTTV
ccceeeeeeeeecccceeeecccchccccceeeeeeeecccccccccecccccccceeeeeeeccccccccchheeeeecccccccchhhhhhcccccceee
ILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRV
eecccchhhhheeeeeehccccccccccccccccccccccccceeeecccccceeeeeeccccccccccceeeeeeeeccccccccccchhhccccceeee
MTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSG
ecccccccchhhhhhhhhhcccccccceeeeeeccccccccccceeeccehhccceeeeeeeeccccccccccccccceeeeeeccccccccccccccceeeeeeecc
QRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITT
cccccccccchhhhhhhhhhhhhhcccccccccccceeeecccccccccccceeeeeeecccccceeecccccccccccchheeeeehhhccceeeeeccccceeecc
PSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAG
cccccccccccccchhhheeeeeccccccccccccccccccccccccceeeeeeeeeccccccceeeccchhhhhhhhhhcccccchhhhhhhhccccchhhh
LYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDH
cchchccchhhhhhhhhhhhhhhhhhhhhhhhcccccceeeeccccccccccccccccccccccccccccchhhhccccccccccccceeeeccccc
GLFSEDGSFIGAYAGSKEKGSVESNGSSTATFPLRA
eeecccccceeeeccccccccceecccccccccccccc Alpha helix (h): 15.78%
Extended strand (e): 26.13%
Random coil (c) : 58.09%

Fig.13H

Secondary structure prediction of 282P1G3B variant 8

```
         10        20        30        40        50        60        70        80        90       100
          |         |         |         |         |         |         |         |         |         |
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHI
ccchhhchhhhhhhhhhhhhcheeeccccchccheeeecceeeeccccchheeehhhcccccccceeccccccceeecccceeecccccccceecccccccc
SHFQGKYRCFASNKLGIAMSEEIEFIVPKLEHIEQDERVYMSQKGDLYFANVEEKDSRNDYCCFAAFPRLRTIVQKMPMKLTVNSLKHANDSSSSTEIGS
chccccchehhccccccceehhhhhhhhcccccccchhhheehhccccceeeeeecccccccccccehhhhhchhhhhhcccceeeecccccccccccccccch
KANSIKQRKPKLLLPPTESGSESSITILKGEILLLECFAEGLPTPQVDWNKIGGDLPKGRETKENYGKTLKIENVSYQDKGNYRCTASNFLGTATHDFHV
chcchccccccceeccccccccccchhehhhhhhhhhhhhhcccccccchchccccccccccccccccceeeeeeeecccccceeeccccccccccceee
IVEDNISHELFTLHPEPPRWTKKPQSAVYSTGSNGILLCEAEGEPQPTIKWRVNGSPVDNHPFAGDVVFPREISFTNLQPNHTAVYQCEASNVHGTILAN
eecccccceeehhcccccccccccccceeeecccceeeeeecccccceeeeeecccccccccccccccceeeeccccccceeeeeccccccceeeeec
ANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRN
cceeeeeccceeeecccccceeeeeeeeeeeeeecccccchheehhhhhhccccccceeeeeecccceeeecccccccccccchehhcccccchhhhhhchcc
ATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPD
cceeeecccccccccceeeeecccccccccccceeeeeecccceeeeccccceeeeeeccceeeeeeeecccceeeeccccchccccccceeeeeeeccc
PPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDR
ccccccecccccccceeeeeeccccccccchheeeeecccccccccchhhhhhccccceeeeecccchhhhhheeeeeehccccccccccccccccccccc
NPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAP
cccceeeecccccceeeeeecccccccccccceeeeeeeccccccccccchhhccccceeeeeccccccchhhhhhhhhhcccccccceeeeeeccccccccc
VIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPE
eeeccehhccceeeeeeeecccccccccccccceeeeeecccccccccccccceeeeeeccccccccccchhhhhhhhhhhhcccccccccccceeeeccc
GVPEQPTFLKVIKVDKDTATLSWGLPKKLNGNLTGYLLQYQIINDTYEIGELNDINITTPSKPSWHLSNLNATTKYKFYLRACTSQGCGKPITEESSTLG
cccccccceeeeeeeeccccceeecccccccccccchheeeeehhhccceeeeccccceeeccccccccccccccccchhhheeeeeccccccccccccccccccc
EGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSV
cccccceeeeeeeeccccccceeecchhhhhhhhhhhcccccchhhhhhhhccccchhhhcchchccchhhhhhhhhhhhhhhhhhhhhhcccccceee
KEKEDLHPDPEIQSVKDETFGEYSDSDEKPLKGSLRSLNRDMQPTESADSLVEYGEGDHGLFSEDGSFIGAYAGSKEKGSVESNGSSTATFPLRA
ecccccccccccccccccccccccccccccccchhhhccccccccccccceeeecccccceeecccccceeeecccccccceecccccccccccccc
```

Alpha helix (h): 16.99%
Extended strand (e): 25.36%
Random coil (c) : 57.66%

1 transmembrane domain predicted 1 transmembrane dor predicted 1 transmembrane domain predicted Transmembrane prediction for 282P1G3B variant 2

1 transmembrane doı predicted

No transmembrane domains predicted

Transmembrane prediction for 282P1G3B variant 3

No transmembrane predicted 1 transmembrane domain predicted 1 transmembrane predicted 1 transmembrane domain predicted 1 transmembrane dom predicted 1 transmembrane domai predicted

Transmembrane prediction for 282P1G3B variant 6

1 transmembrane predicted 1 transmembrane domain predicted

Transmembrane prediction for 282P1G3B variant 7

1 transmembrane doı predicted 1 transmembrane d
predicted 1 transmembrane d
predicted

Fig. 14A 282P1G3 Expression by RT-PCR
M = Marker
1. Vital Pool 1
2. Vital Pool 2
3. Normal pancreas
4. Ovary Cancer Pool
5. Pancreas Cancer Pool
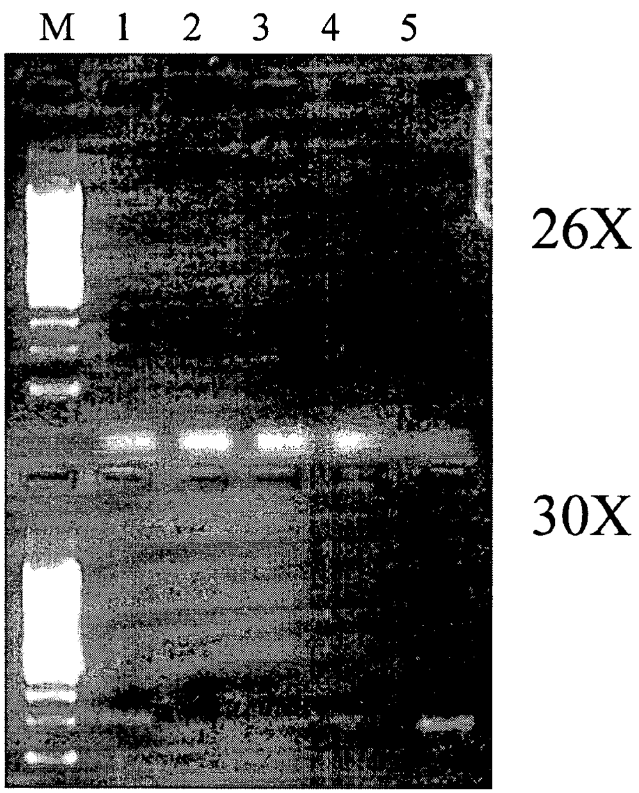

Fig. 15 282P1G3 Expression in Normal Tissues
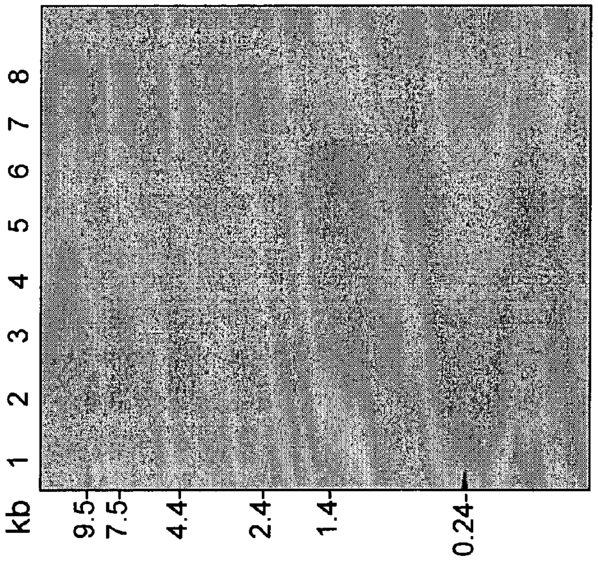
1. Heart
2. Brain
3. Placenta
4. Lung
5. Liver
6. Skeletal Muscle
7. Kidney
8. Pancreas
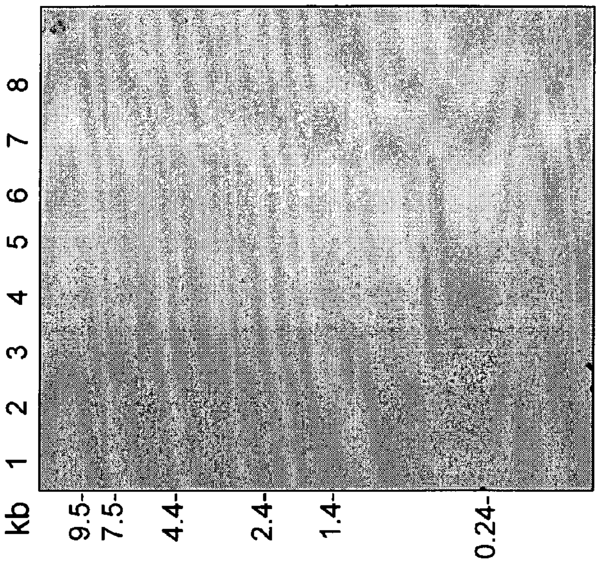
1. Spleen
2. Thymus
3. Prostate
4. Testis
5. Uterus
6. Small Intestine
7. Colon
8. Leukocytes

Fig. 16 Expression of 282P1G3 in Pancreas Cancer Patient Specimens
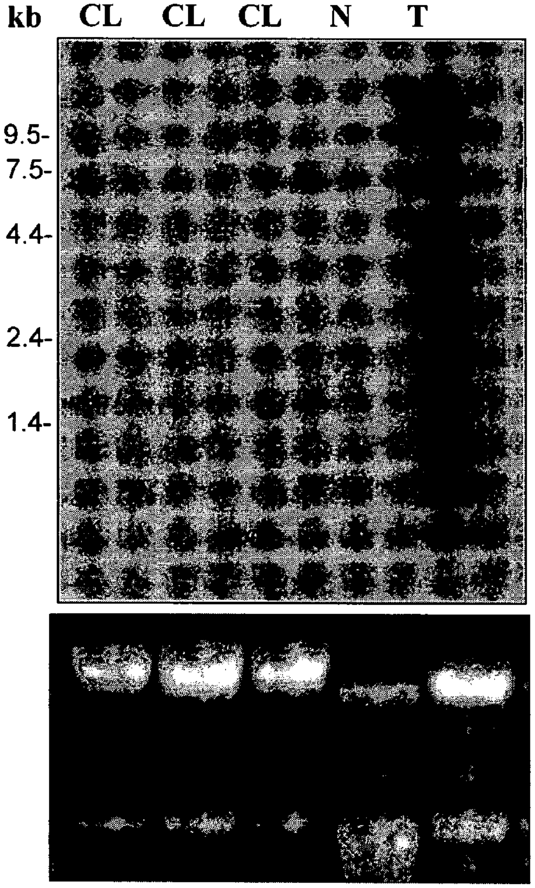
*CL* = *Cell lines (from left to right): PANC-1, Bx PC-3, HPAC*
*N* = *Normal pancreas*
*T* = *Pancreatic Tumor*

Fig. 17 Expression of 282P1G3 in Ovary Cancer Patient Specimens
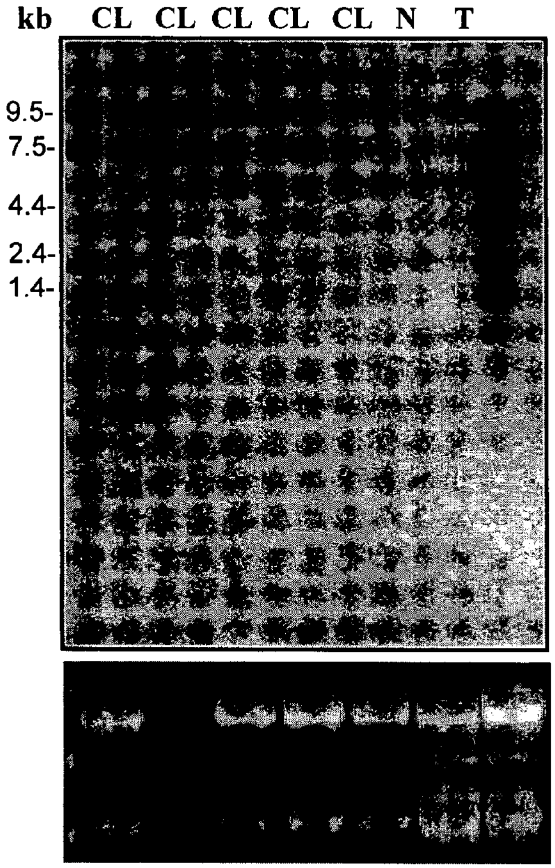
*CL* = *Cell lines (from left to right): A431, Hela, OV-1063, PA-1, SW-626*
*N* = *Normal ovary*
*T* = *Ovary Tumor*

Fig. 18 282P1G3 Expression in Patient Lymphoma Specimens
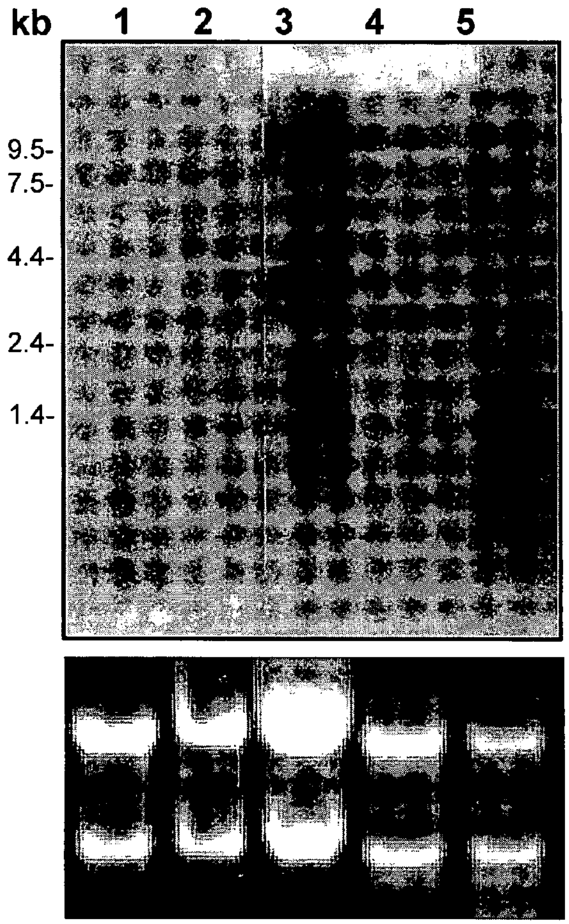
1. Peripheral Blood Lymphocytes
2. Cord Blood
3. Diffuse mixed large & small cell lymphoma-Stage II
4. Diffuse large cell lymphoma-Stage I
5. Diffuse large B-cell type
   CD20+,CD10+,CD22+,CD14-,CD38-,CD5-,CD3-

Fig. 19 282P1G3 Expression in 293T Cells Following Transfection of 282P1G3.pcDNA3.1/MycHis Construct
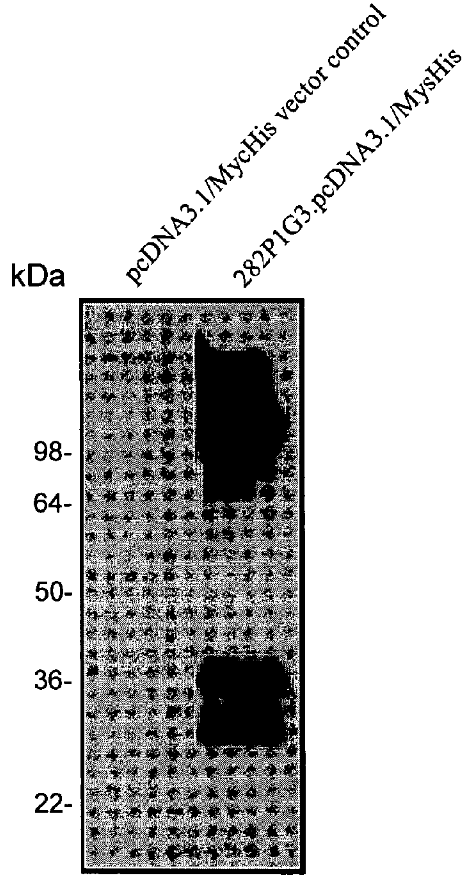

Fig. 20 282P1G3 Secretion in 293T Cells Following Transfection of 282P1G3.pTag5 Construct
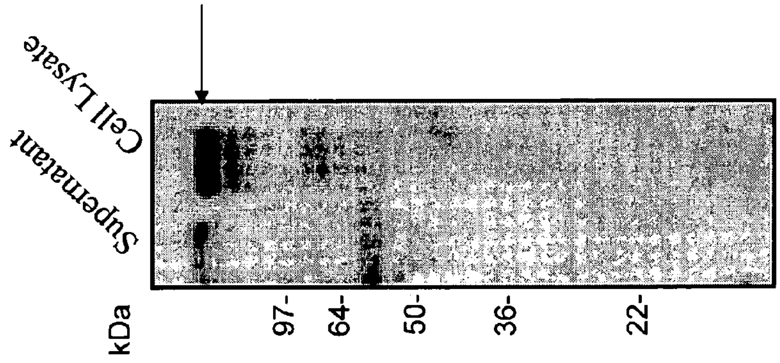

NUCLEIC ACIDS AND CORRESPONDING PROTEINS ENTITLED 282P1G3 USEFUL IN TREATMENT AND DETECTION OF CANCER

CROSS-REFERENCE TO RELATED APPLICATIONS

This application is a non-provisional utility patent application that claims priority from U.S. provisional patent application Ser. No. 60/404,306, filed 16 Aug. 2002 and this application claims priority from U.S. provisional patent application Ser. No. 60/423,290, filed 1 Nov. 2002. The contents of the applications listed in this paragraph are fully incorporated by reference herein.

STATEMENT OF RIGHTS TO INVENTIONS MADE UNDER FEDERALLY SPONSORED RESEARCH

Not applicable.

FIELD OF THE INVENTION

The invention described herein relates to genes and their encoded proteins, termed 282P1G3, expressed in certain cancers, and to diagnostic and therapeutic methods and compositions useful in the management of cancers that express 282P1G3.

BACKGROUND OF THE INVENTION

Cancer is the second leading cause of human death next to coronary disease. Worldwide, millions of people die from cancer every year. In the United States alone, as reported by the American Cancer Society, cancer causes the death of well over a half-million people annually, with over 1.2 million new cases diagnosed per year. While deaths from heart, disease have been declining significantly, those resulting from cancer generally are on the rise. In the early part of the next century, cancer is predicted to become the leading cause of death.

Worldwide, several cancers stand out as the leading killers. In particular, carcinomas of the lung, prostate, breast, colon, pancreas, and ovary represent the primary causes of cancer death. These and virtually all other carcinomas share a common lethal feature. With very few exceptions, metastatic disease from a carcinoma is fatal. Moreover, even for those cancer patients who initially survive their primary cancers, common experience has shown that their lives are dramatically altered. Many cancer patients experience strong anxieties driven by the awareness of the potential for recurrence or treatment failure. Many cancer patients experience physical debilitations following treatment. Furthermore, many cancer patients experience a recurrence.

Worldwide, prostate cancer is the fourth most prevalent cancer in men. In North America and Northern Europe, it is by far the most common cancer in males and is the second leading cause of cancer death in men. In the United States alone, well over 30,000 men die annually of this disease—second only to lung cancer. Despite the magnitude of these figures, there is still no effective treatment for metastatic prostate cancer. Surgical prostatectomy, radiation therapy, hormone ablation therapy, surgical castration and chemotherapy continue to be the main treatment modalities. Unfortunately, these treatments are ineffective for many and are often associated with undesirable consequences.

On the diagnostic front, the lack of a prostate tumor marker that can accurately detect early-stage, localized tumors remains a significant limitation in the diagnosis and management of this disease. Although the serum prostate specific antigen (PSA) assay has been a very useful tool, however its specificity and general utility is widely regarded as lacking in several important respects.

Progress in identifying additional specific markers for prostate cancer has been improved by the generation of prostate cancer xenografts that can recapitulate different stages of the disease in mice. The LAPC (Los Angeles Prostate Cancer) xenografts are prostate cancer xenografts that have survived passage in severe combined immune deficient (SCID) mice and have exhibited the capacity to mimic the transition from androgen dependence to androgen independence (Klein et al., 1997, Nat. Med. 3:402). More recently identified prostate cancer markers include PCTA-1 (Su et al., 1996, Proc. Natl. Acad. Sci. USA 93: 7252), prostate-specific membrane (PSM) antigen (Pinto et al., Clin Cancer Res 1996 Sep. 2 (9): 1445–51), STEAP (Hubert, et al., Proc Natl Acad Sci USA. 1999 Dec. 7; 96(25): 14523–8) and prostate stem cell antigen (PSCA) (Reiter et al., 1998, Proc. Natl. Acad. Sci. USA 95: 1735).

While previously identified markers such as PSA, PSM, PCTA and PSCA have facilitated efforts to diagnose and treat prostate cancer, there is need for the identification of additional markers and therapeutic targets for prostate and related cancers in order to further improve diagnosis and therapy. Renal cell carcinoma (RCC) accounts for approximately 3 percent of adult malignancies. Once adenomas reach a diameter of 2 to 3 cm, malignant potential exists. In the adult, the two principal malignant renal tumors are renal cell adenocarcinoma and transitional cell carcinoma of the renal pelvis or ureter. The incidence of renal cell adenocarcinoma is estimated at more than 29,000 cases in the United States, and more than 11,600 patients died of this disease in 1998. Transitional cell carcinoma is less frequent, with an incidence of approximately 500 cases per year in the United States.

Surgery has been the primary therapy for renal cell adenocarcinoma for many decades. Until recently, metastatic disease has been refractory to any systemic therapy. With recent developments in systemic therapies, particularly immunotherapies, metastatic renal cell carcinoma may be approached aggressively in appropriate patients with a possibility of durable responses. Nevertheless, there is a remaining need for effective therapies for these patients.

Of all new cases of cancer in the United States, bladder cancer represents approximately 5 percent in men (fifth most common neoplasm) and 3 percent in women (eighth most common neoplasm). The incidence is increasing slowly, concurrent with an increasing older population. In 1998, there was an estimated 54,500 cases, including 39,500 in men and 15,000 in women. The age-adjusted incidence in the United States is 32 per 100,000 for men and eight per 100,000 in women. The historic male/female ratio of 3:1 may be decreasing related to smoking patterns in women. There were an estimated 11,000 deaths from bladder cancer in 1998 (7,800 in men and 3,900 in women). Bladder cancer incidence and mortality strongly increase with age and will be an increasing problem as the population becomes more elderly.

Most bladder cancers recur in the bladder. Bladder cancer is managed with a combination of transurethral resection of the bladder (TUR) and intravesical chemotherapy or immunotherapy. The multifocal and recurrent nature of bladder cancer points out the limitations of TUR. Most muscle-invasive cancers are not cured by TUR alone. Radical cystectomy and urinary diversion is the most effective means to eliminate the cancer but carry an undeniable impact on urinary and sexual function. There continues to be a significant need for treatment modalities that are beneficial for bladder cancer patients.

An estimated 130,200 cases of colorectal cancer occurred in 2000 in the United States, including 93,800 cases of colon cancer and 36,400 of rectal cancer. Colorectal cancers are the third most common cancers in men and women. Incidence rates declined significantly during 1992–1996 (−2.1% per year). Research suggests that these declines have been due to increased screening and polyp removal, preventing progression of polyps to invasive cancers. There were an estimated 56,300 deaths (47,700 from colon cancer, 8,600 from rectal cancer) in 2000, accounting for about 11% of all U.S. cancer deaths.

At present, surgery is the most common form of therapy for colorectal cancer, and for cancers that have not spread, it is frequently curative. Chemotherapy, or chemotherapy plus radiation, is given before or after surgery to most patients whose cancer has deeply perforated the bowel wall or has spread to the lymph nodes. A permanent colostomy (creation of an abdominal opening for elimination of body wastes) is occasionally needed for colon cancer and is infrequently required for rectal cancer. There continues to be a need for effective diagnostic and treatment modalities for colorectal cancer.

There were an estimated 164,100 new cases of lung and bronchial cancer in 2000, accounting for 14% of all U.S. cancer diagnoses. The incidence rate of lung and bronchial cancer is declining significantly in men, from a high of 86.5 per 100,000 in 1984 to 70.0 in 1996. In the 1990s, the rate of increase among women began to slow. In 1996, the incidence rate in women was 42.3 per 100,000.

Lung and bronchial cancer caused an estimated 156,900 deaths in 2000, accounting for 28% of all cancer deaths. During 1992–1996, mortality from lung cancer declined significantly among men (−1.7% per year) while rates for women were still significantly increasing (0.9% per year). Since 1987, more women have died each year of lung cancer than breast cancer, which, for over 40 years, was the major cause of cancer death in women. Decreasing lung cancer incidence and mortality rates most likely resulted from decreased smoking rates over the previous 30 years; however, decreasing smoking patterns among women lag behind those of men. Of concern, although the declines in adult tobacco use have slowed, tobacco use in youth is increasing again.

Treatment options for lung and bronchial cancer are determined by the type and stage of the cancer and include surgery, radiation therapy, and chemotherapy. For many localized cancers, surgery is usually the treatment of choice. Because the disease has usually spread by the time it is discovered, radiation therapy and chemotherapy are often needed in combination with surgery. Chemotherapy alone or combined with radiation is the treatment of choice for small cell lung cancer; on this regimen, a large percentage of patients experience remission, which in some cases is long lasting. There is however, an ongoing need for effective treatment and diagnostic approaches for lung and bronchial cancers.

An estimated 182,800 new invasive cases of breast cancer were expected to occur among women in the United States during 2000. Additionally, about 1,400 new cases of breast cancer were expected to be diagnosed in men in 2000. After increasing about 4% per year in the 1980s, breast cancer incidence rates in women have leveled off in the 1990s to about 110.6 cases per 100,000.

In the U.S. alone, there were an estimated 41,200 deaths (40,800 women, 400 men) in 2000 due to breast cancer. Breast cancer ranks second among cancer deaths in women. According to the most recent data, mortality rates declined significantly during 1992–1996 with the largest decreases in younger women, both white and black. These decreases were probably the result of earlier detection and improved treatment.

Taking into account the medical circumstances and the patient's preferences, treatment of breast cancer may involve lumpectomy (local removal of the tumor) and removal of the lymph nodes under the arm; mastectomy (surgical removal of the breast) and removal of the lymph nodes under the arm; radiation therapy; chemotherapy; or hormone therapy. Often, two or more methods are used in combination. Numerous studies have shown that, for early stage disease, long-term survival rates after lumpectomy plus radiotherapy are similar to survival rates after modified radical mastectomy. Significant advances in reconstruction techniques provide several options for breast reconstruction after mastectomy. Recently, such reconstruction has been done at the same time as the mastectomy.

Local excision of ductal carcinoma in situ (DCIS) with adequate amounts of surrounding normal breast tissue may prevent the local recurrence of the DCIS. Radiation to the breast and/or tamoxifen may reduce the chance of DCIS occurring in the remaining breast tissue. This is important because DCIS, if left untreated, may develop into invasive breast cancer. Nevertheless, there are serious side effects or sequelae to these treatments. There is, therefore, a need for efficacious breast cancer treatments.

There were an estimated 23,100 new cases of ovarian cancer in the United States in 2000. It accounts for 4% of all cancers among women and ranks second among gynecologic cancers. During 1992–1996, ovarian cancer incidence rates were significantly declining. Consequent to ovarian cancer, there were an estimated 14,000 deaths in 2000. Ovarian cancer causes more deaths than any other cancer of the female reproductive system.

Surgery, radiation therapy, and chemotherapy are treatment options for ovarian cancer. Surgery usually includes the removal of one or both ovaries, the fallopian tubes (salpingo-oophorectomy), and the uterus (hysterectomy). In some very early tumors, only the involved ovary will be removed, especially in young women who wish to have children. In advanced disease, an attempt is made to remove all intra-abdominal disease to enhance the effect of chemotherapy. There continues to be an important need for effective treatment options for ovarian cancer.

There were an estimated 28,300 new cases of pancreatic cancer in the United States in 2000. Over the past 20 years, rates of pancreatic cancer have declined in men. Rates among women have remained approximately constant but may be beginning to decline. Pancreatic cancer caused an estimated 28,200 deaths in 2000 in the United States. Over the past 20 years, there has been a slight but significant decrease in mortality rates among men (about −0.9% per year) while rates have increased slightly among women.

Surgery, radiation therapy, and chemotherapy are treatment options for pancreatic cancer. These treatment options can extend survival and/or relieve symptoms in many patients but are not likely to produce a cure for most. There is a significant need for additional therapeutic and diagnostic options for pancreatic cancer.

SUMMARY OF THE INVENTION

The present invention relates to a gene, designated 282P1G3, that has now been found to be over-expressed in the cancer(s) listed in Table I. Northern blot expression analysis of 282P1G3 gene expression in normal tissues shows a restricted expression pattern in adult tissues. The nucleotide (FIG. 2) and amino acid (FIG. 2, and FIG. 3) sequences of 282P1G3 are provided. The tissue-related profile of 282P1G3 in normal adult tissues, combined with the observed in the tissues listed in Table I, shows that 282P1G3 is aberrantly over-expressed in at least some cancers, and thus serves as a useful diagnostic, prophylactic, prognostic, and/or therapeutic target for cancers of the tissue(s) such as those listed in Table I.

The invention provides polynucleotides corresponding or complementary to all or part of the 282P1G3 genes, mRNAs, and/or coding sequences, preferably in isolated form, including polynucleotides encoding 282P1G3-related proteins and fragments of 4, 5, 6, 7, 8, 9, 10, 11, 12, 13, 14, 15, 16, 17, 18, 19, 20, 21, 22, 23, 24, 25, or more than 25 contiguous amino acids; at least 30, 35, 40, 45, 50, 55, 60, 65, 70, 80, 85, 90, 95, 100 or more than 100 contiguous amino acids of a 282P1G3-related protein, as well as the peptides/proteins themselves; DNA, RNA, DNA/RNA hybrids, and related molecules, polynucleotides or oligonucleotides complementary or having at least a 90% homology to the 282P1G3 genes or mRNA sequences or parts thereof, and polynucleotides or oligonucleotides that hybridize to the 282P1G3 genes, mRNAs, or to 282P1G3-encoding polynucleotides, Also provided are means for isolating cDNAs and the genes encoding 282P1G3. Recombinant DNA molecules containing 282P1G3 polynucleotides, cells transformed or transduced with such molecules, and host-vector systems for the expression of 282P1G3 gene products are also provided. The invention further provides antibodies that bind to 282P1G3 proteins and polypeptide fragments thereof, including polyclonal and monoclonal antibodies, murine and other mammalian antibodies, chimeric antibodies, humanized and fully human antibodies, and antibodies labeled with a detectable marker or therapeutic agent. In certain embodiments, there is a proviso that the entire nucleic acid sequence of FIG. 2 is not encoded and/or the entire amino acid sequence of FIG. 2 is not prepared. In certain embodiments, the entire nucleic acid sequence of FIG. 2 is encoded and/or the entire amino acid sequence of FIG. 2 is prepared, either of which are in respective human unit dose forms.

The invention further provides methods for detecting the presence and status of 282P1G3 polynucleotides and proteins in various biological samples, as well as methods for identifying cells that express 282P1G3. A typical embodiment of this invention provides methods for monitoring 282P1G3 gene products in a tissue or hematology sample having or suspected of having some form of growth dysregulation such as cancer.

The invention further provides various immunogenic or therapeutic compositions and strategies for treating cancers that express 282P1G3 such as cancers of tissues listed in Table I, including therapies aimed at inhibiting the transcription, translation, processing or function of 282P1G3 as well as cancer vaccines. In one aspect, the invention provides compositions, and methods comprising them, for treating a cancer that expresses 282P1G3 in a human subject wherein the composition comprises a carrier suitable for human use and a human unit dose of one or more than one agent that inhibits the production or function of 282P1G3. Preferably, the carrier is a uniquely human carrier. In another aspect of the invention, the agent is a moiety that is immunoreactive with 282P1G3 protein. Non-limiting examples of such moieties include, but are not limited to, antibodies (such as single chain, monoclonal, polyclonal, humanized, chimeric, or human antibodies), functional equivalents thereof (whether naturally occurring or synthetic), and combinations thereof. The antibodies can be conjugated to a diagnostic or therapeutic moiety. In another aspect, the agent is a small molecule as defined herein.

In another aspect, the agent comprises one or more than one peptide which comprises a cytotoxic T lymphocyte (CTL) epitope that binds an HLA class I molecule in a human to elicit a CTL response to 282P1G3 and/or one or more than one peptide which comprises a helper T lymphocyte (HTL) epitope which binds an HLA class II molecule in a human to elicit an HTL response. The peptides of the invention may be on the same or on one or more separate polypeptide molecules. In a further aspect of the invention, the agent comprises one or more than one nucleic acid molecule that expresses one or more than one of the CTL or HTL response stimulating peptides as described above. In yet another aspect of the invention, the one or more than one nucleic acid molecule may express a moiety that is immunologically reactive with 282P1G3 as described above. The one or more than one nucleic acid molecule may also be, or encodes, a molecule that inhibits production of 282P1G3. Non-limiting examples of such molecules include, but are not limited to, those complementary to a nucleotide sequence essential for production of 282P1G3 (e.g. antisense sequences or molecules that form a triple helix with a nucleotide double helix essential for 282P1G3 production) or a ribozyme effective to lyse 282P1G3 mRNA.

Note that to determine the starting position of any peptide set forth in Tables VIII–XXI and XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides in Table VII. Generally, a unique Search Peptide is used to obtain HLA peptides of a particular for a particular variant. The position of each Search Peptide relative to its respective parent molecule is listed in Table VII. Accordingly, if a Search Peptide begins at position "X", one must add the value "X−1" to each position in Tables VIII–XXI and XXII to XLIX to obtain the actual position of the HLA peptides in their parental molecule. For example, if a particular Search Peptide begins at position 150 of its parental molecule, one must add 150−1, i.e., 149 to each HLA peptide amino acid position to calculate the position of that amino acid in the parent molecule.

One embodiment of the invention comprises an HLA peptide, that occurs at least twice in Tables VIII–XXI and XXII to XLIX collectively, or an oligonucleotide that encodes the HLA peptide. Another embodiment of the invention comprises an HLA peptide that occurs at least once in Tables VIII–XXI and at least once in tables XXII to XLIX, or an oligonucleotide that encodes the HLA peptide.

Another embodiment of the invention is antibody epitopes, which comprise a peptide regions, or an oligonucleotide encoding the peptide region, that has one two, three, four, or five of the following characteristics:

i) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a peptide region of at least 5 amino acids of a particular peptide of FIG. 3, in any whole number increment up to the full length of that protein FIG. 3, that includes an amino acid position having a value equal to or less than 0.5, 0.4, 0.3, 0.2, 0.1, or having a value equal to 0.0, in the Hydropathicity profile of FIG. 6;

iii) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or v) a peptide region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9.

Figures 1, 10:
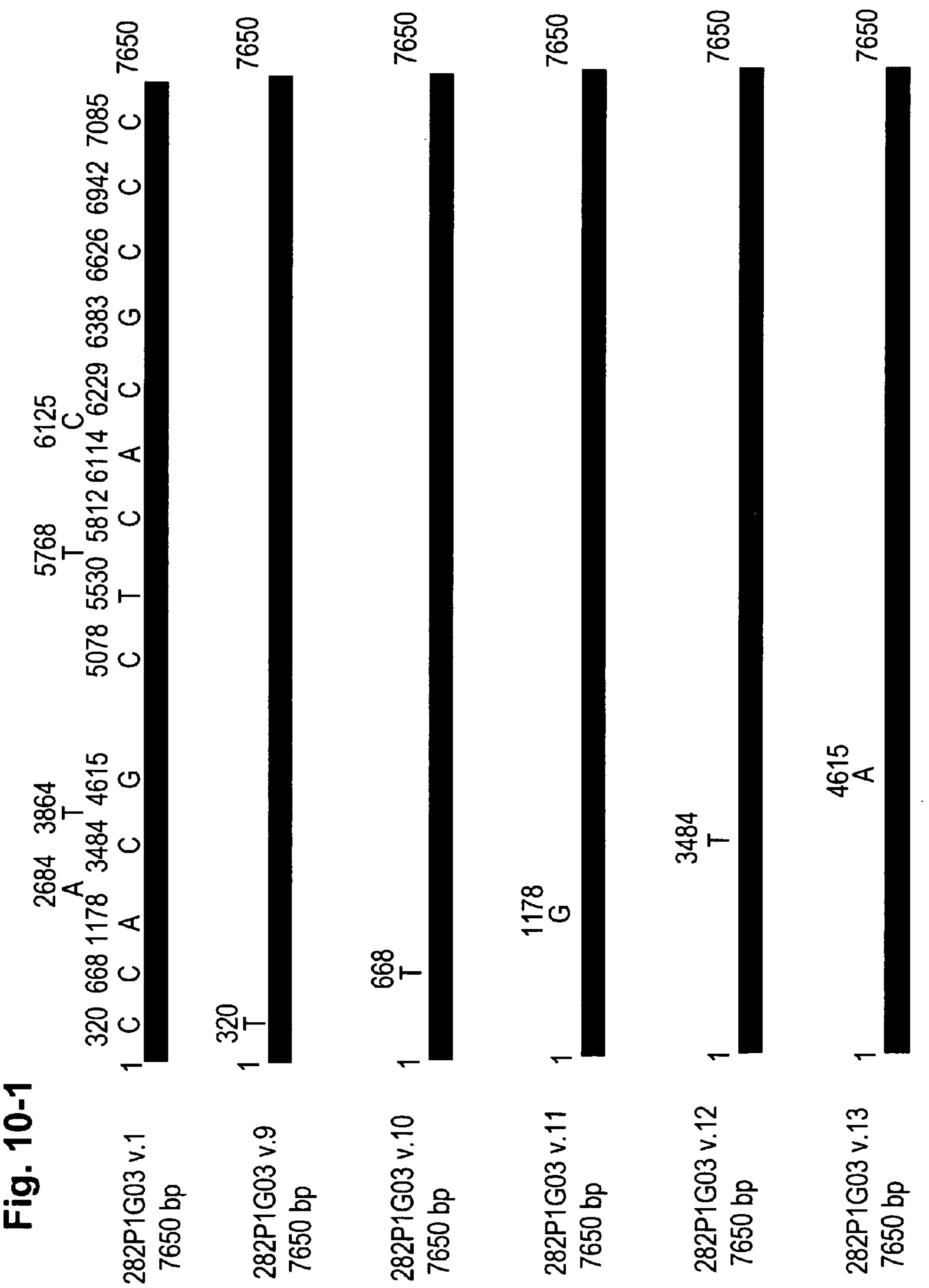
FIG. 1. The 282P1G3 SSH sequence of 321 nucleotides.

B) The cDNA and amino acid sequence of 282P1G3 variant 2 (also called "282P1G3 v.2") is shown in FIG. 2B. The codon for the start methionine is underlined. The open reading frame extends from nucleic acid 272–3787 including the stop codon.

C) The cDNA and amino acid sequence of 282P1G3 variant 3 (also called "282P1G3 v.3") is shown in FIG. 2C. The codon for the start methionine is underlined. The open reading frame extends from nucleic acid 272–2953 including the stop codon.

D) The cDNA and amino acid sequence of 282P1G3 variant 4 (also called "282P1G3 v.4") is shown in FIG. 2D. The codon for the start methionine is underlined. The open reading frame extends from nucleic acid 272–3625 including the stop codon.

E) The cDNA and amino acid sequence of 282P1G3 variant 5 (also called "282P1G3 v.5") is shown in FIG. 2E. The codon for the start methionine is underlined. The open reading frame extends from nucleic acid 272–3898 including the stop codon.

F) The cDNA and amino acid sequence of 282P1G3 variant 6 (also called "282P1G3 v.6") is shown in FIG. 2F. The codon for the start methionine is underlined. The open reading frame extends from nucleic acid 272–3823 including the stop codon.

G) The cDNA and amino acid sequence of 282P1G3 variant 7 (also called "282P1G3 v.7") is shown in FIG. 2G. The codon for the start methionine is underlined. The open reading frame extends from nucleic acid 272–3982 including the stop codon.

H) The cDNA and amino acid sequence of 282P1G3 variant 8 (also called "282P1G3 v.8") is shown in FIG. 2H. The codon for the start methionine is underlined. The open reading frame extends from nucleic acid 272–3859 including the stop codon.

I) The cDNA and amino acid sequence of 282P1G3 variant 28 (also called "282P1G3 v.28") is shown in FIG. 2I. The codon for the start methionine is underlined. The open reading frame extends from nucleic acid 192–3866 including the stop codon.

J) The cDNA and amino acid sequence of 282P1G3 variant 14 (also called "282P1G3 v.14") is shown in FIG. 2J. The codon for the start methionine is underlined. The open reading frame extends from nucleic acid 272–3946 including the stop codon.

K) SNP variants of 282P1G3 v.1. 282P1G3 v.9 through v.25. The 282P1G3 v.9 through v.23 proteins have 1224 amino acids. Variants 282P1G3 v.9 through v.25 are variants with single nucleotide difference from 282P1G3 v.1. 282P1G3 v.9, v.10, v.11, v.24 and v.25 proteins differ from 282P1G3v.1 byone amino acid. 282P1G3 v.12 through v.23, v.26 and v.27 code for the same protein as v.1. Though these SNP variants are shown separately, they can also occur in any combinations and in any of the transcript variants listed above in FIGS. 2A through 2I.

FIG. 3.

A) The amino acid sequence of 282P1G3 v.1 is shown in FIG. 3A; it has 1224 amino acids.

B) The amino acid sequence of 282P1G3 v.2 is shown in FIG. 3B; it has 1171 amino acids.

C) The amino acid sequence of 282P1G3 v.3 is shown in FIG. 3C; it has 893 amino acids.

D) The amino acid sequence of 282P1G3 v.4 is shown in FIG. 3D; it has 1117 amino acids.

E) The amino acid sequence of 282P1G3 v.5 is shown in FIG. 3E; it has 1208 amino acids.

F) The amino acid sequence of 282P1G3 v.6 is shown in FIG. 3F; it has 1183 amino acids.

G) The amino acid sequence of 282P1G3 v.7 is shown in FIG. 3G; it has 1236 amino acids.

H) The amino acid sequence of 282P1G3 v.8 is shown in FIG. 3H; it has 1195 amino acids.

I) The amino acid sequence of 282P1G3 v.9 is shown in FIG. 3I; it has 1224 amino acids.

J) The amino acid sequence of 282P1G3 v.10 is shown in FIG. 3J; it has 1224 amino acids.

K) The amino acid sequence of 282P1G3 v.11 is shown in FIG. 3*k*; it has 1224 amino acids.

L) The amino acid sequence of 282P1G3 v.24 is shown in FIG. 3L; it has 1224 amino acids.

M) The amino acid sequence of 282P1G3 v.25 is shown in FIG. 3M; it has 1224 amino acids.

As used herein, a reference to 282P1G3 includes all variants thereof, including those shown in FIGS. 2, 3, 10, and 11, unless the context clearly indicates otherwise.

Figures 2, 10:
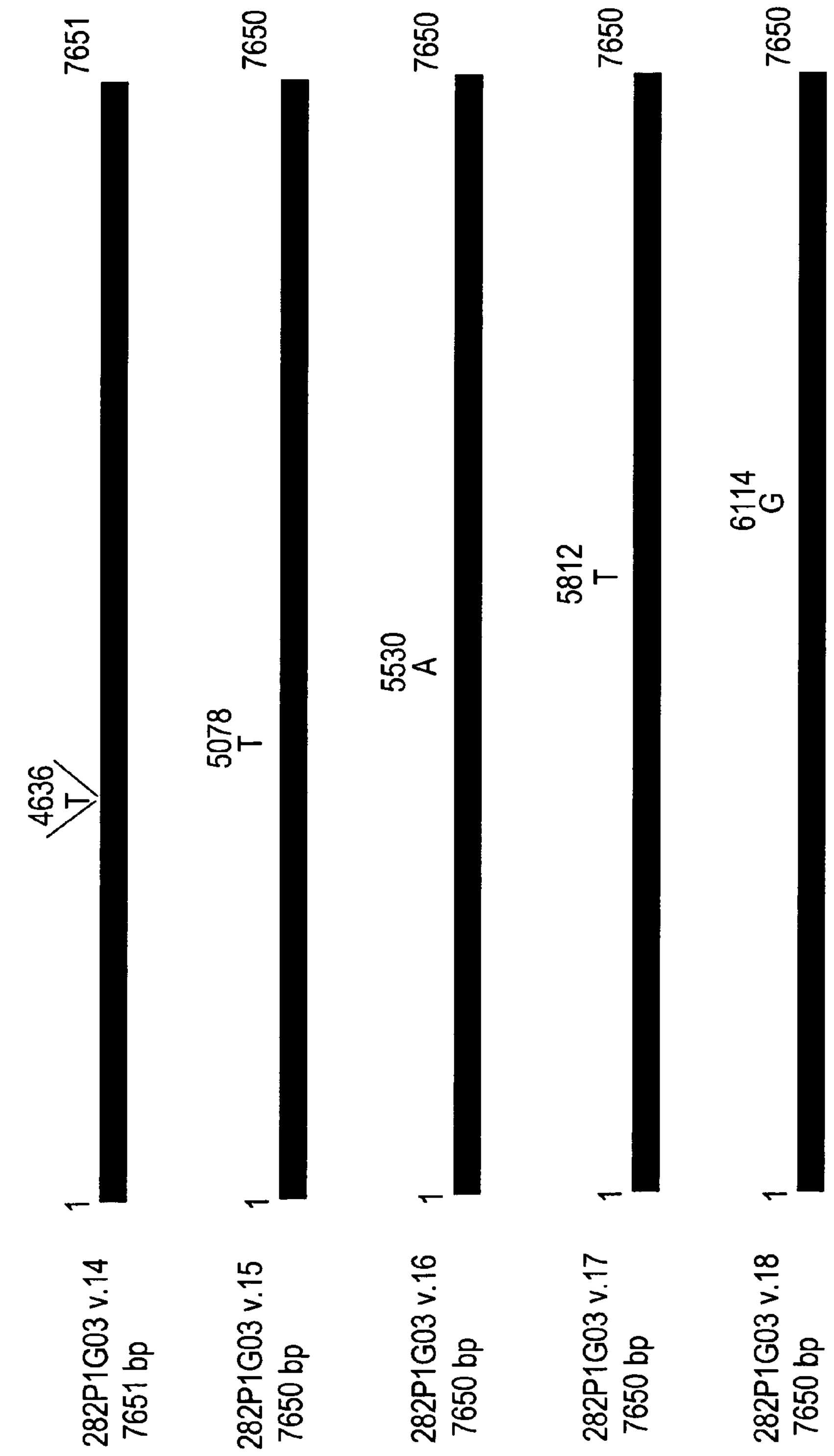
FIG. 2. A) The cDNA and amino acid sequence of 282P1G3 variant 1 (also called "282P1G3 v.1" or "282P1G3 variant 1") is shown in FIG. 2A. The start methionine is underlined. The open reading frame extends from nucleic acid 272–3946 including the stop codon.
Figures 3, 10:
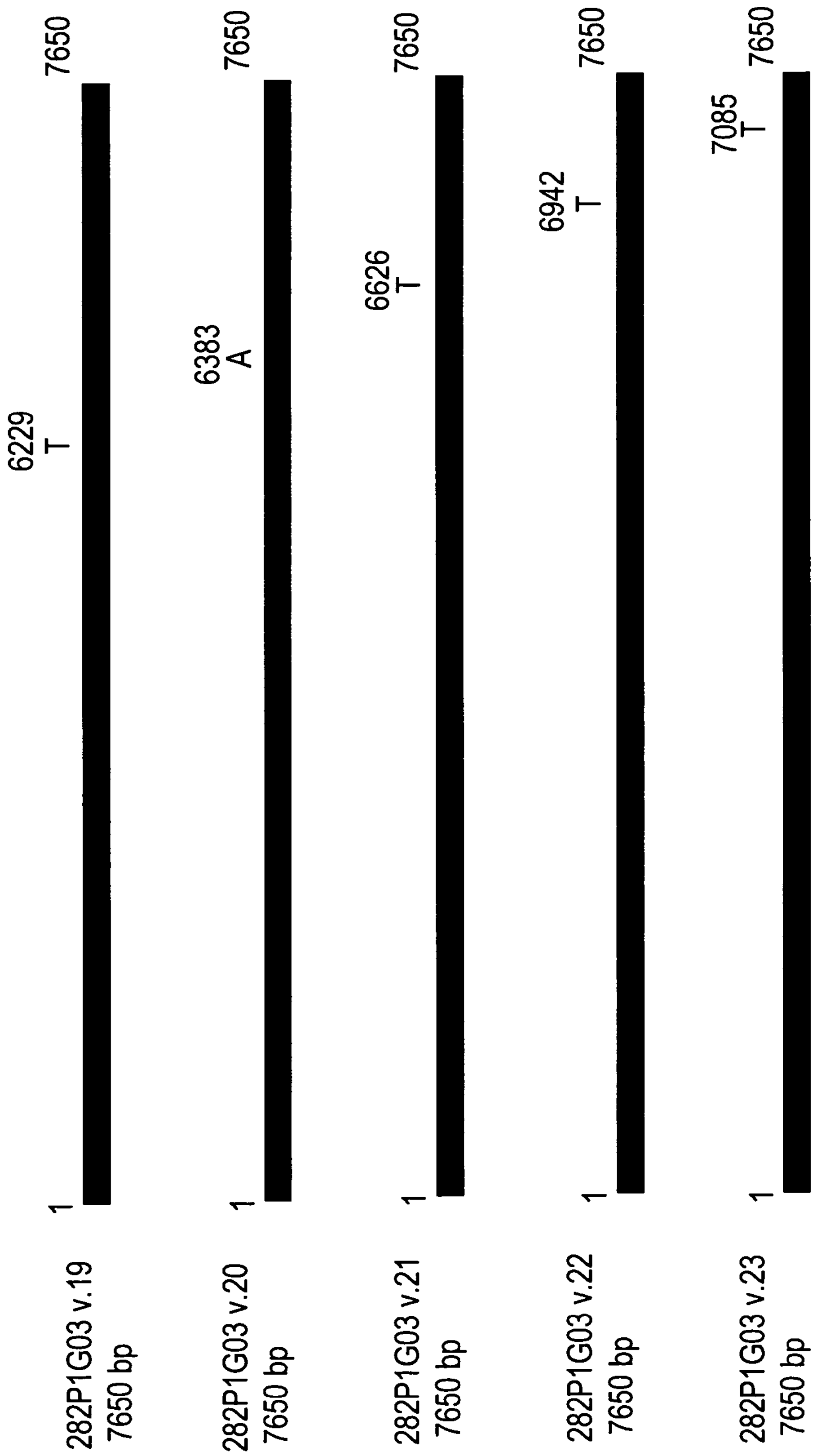
Figures 4, 10:
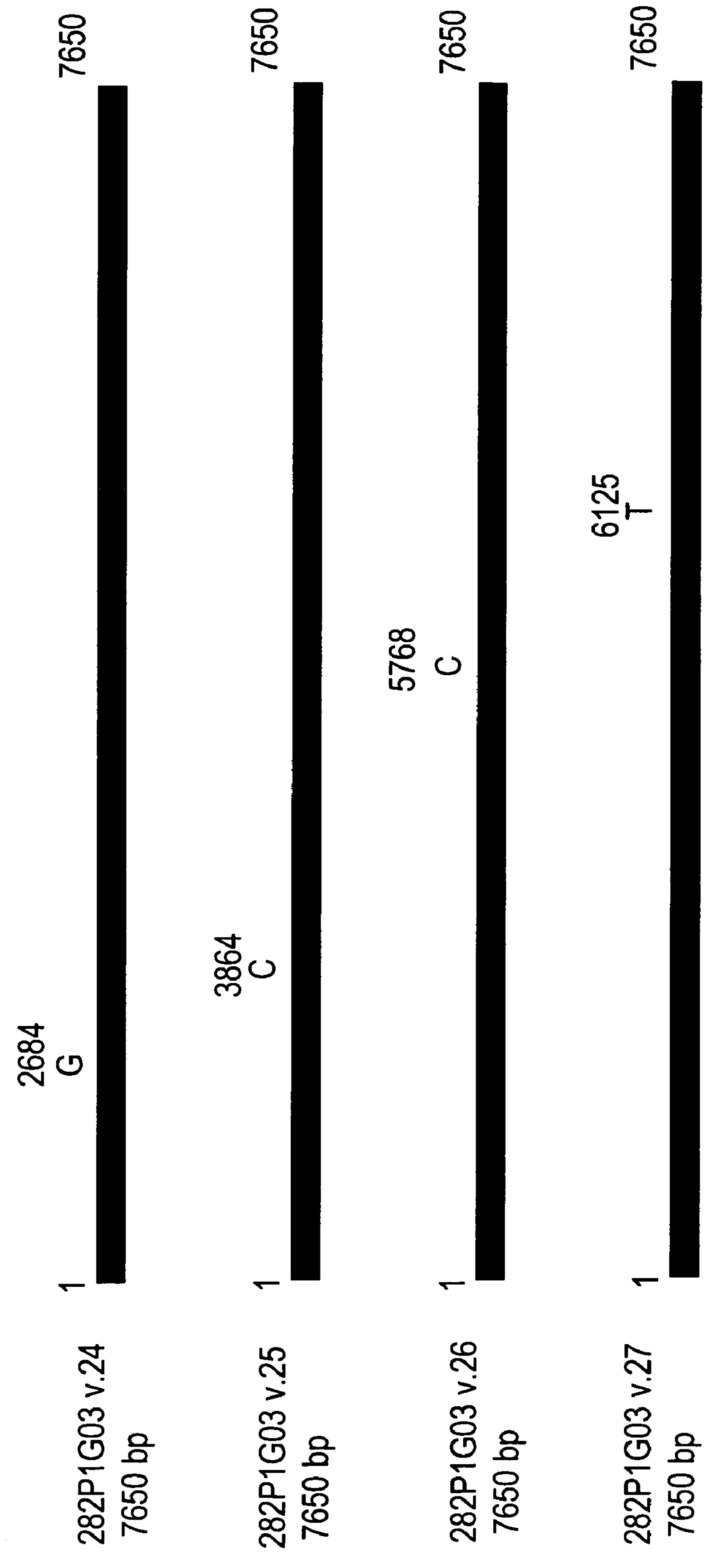

FIG. 4. FIG. 4A: Alignment of 282P1G3 with human close homolog of L1 (gi 27894376). FIG. 4B: Alignment of 282P1G3 with mouse close homolog of L1 (gi 6680936).

FIG. 5. FIGS. 5(*a*)–(*c*): Hydrophilicity amino acid profile of 282P1G3v.1, v.3, and v.7 determined by computer algorithm sequence analysis using the method of Hopp and Woods (Hopp T. P., Woods K. R., 1981. Proc. Natl. Acad. Sci. U.S.A. 78:3824–3828) accessed on the Protscale website located on the World Wide Web through the ExPasy molecular biology server.

FIG. 6. FIGS. 6(*a*)–(*c*): Hydropathicity amino acid profile of282P1G3v.1, v.3, and v.7 determined by computer algorithm sequence analysis using the method of Kyte and Doolittle (Kyte J., Doolittle R. F., 1982. J. Mol. Biol. 157:105–132) accessed on the ProtScale website located on the World Wide Web through the ExPasy molecular biology server.

FIG. 7. FIGS. 7(*a*)–(*c*): Percent accessible residues amino acid profile of 282P1G3v.1, v.3, and v.7 determined by computer algorithm sequence analysis using the method of Janin (Janin J., 1979 Nature 277:491–492) accessed on the ProtScale website located on the World Wide Web through the ExPasy molecular biology server.

FIG. 8. FIGS. 8(*a*)–(*c*): Average flexibility amino acid profile of 282P1G3v.1, v.3, and v.7 determined by computer algorithm sequence analysis using the method of Bhaskaran and Ponnuswamy (Bhaskaran R., and Ponnuswamy P. K., 1988. Int. J. Pept. Protein Res. 32:242–255) accessed on the ProtScale website located on the World Wide Web through the ExPasy molecular biology server.

FIG. 9. FIGS. 9(*a*)–(*c*): Beta-turn amino acid profile of282P1G3v.1, v.3, and v.7 determined by computer algorithm sequence analysis using the method of Deleage and Roux (Deleage, G., Roux B. 1987 Protein Engineering 1:289–294) accessed on the ProtScale website located on the World Wide Web through the ExPasy molecular biology server.

Figures 1, 12:
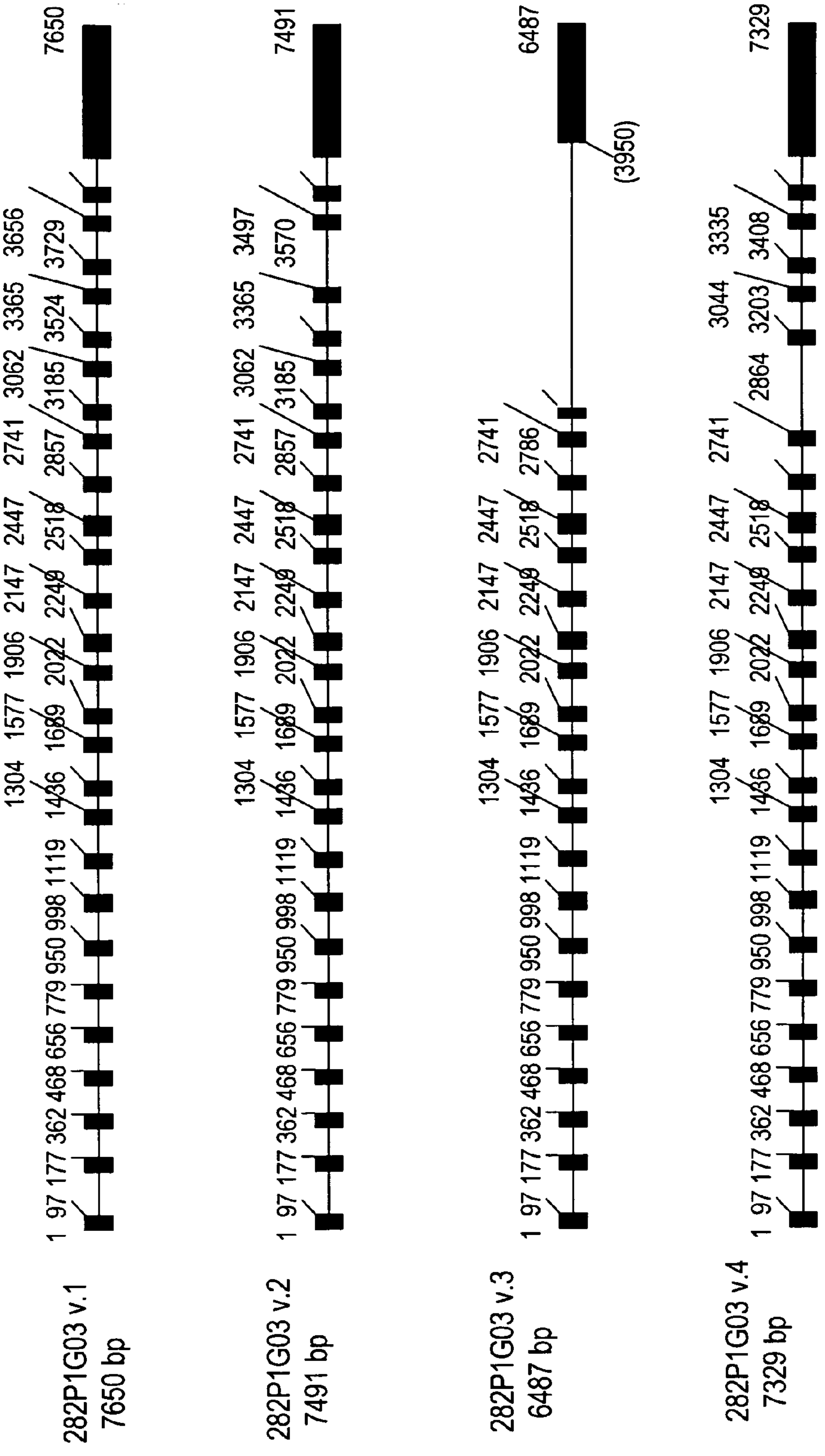
Figures 2, 12:
Figures 3, 12:
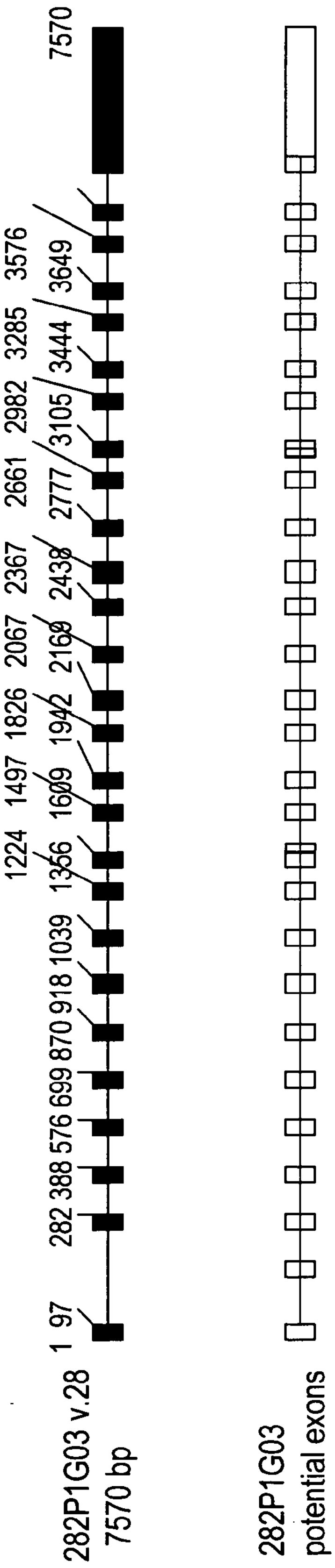

FIG. 10. Schematic alignment of SNP variants of 282P1G03 v.1. Variants 282P1G03 v.9 through v.27 are variants with single nucleotide difference from v.1. Variant v.14 inserted a 'T' between 4635 and 4636 of v.1. Through these SNP variants are shown separately, they can also occur in any combinations and in any transcript variants as shown in FIG. 12, e.g. v.2, that contains the bases. Numbers correspond to those of 282P1G03 v.1. Black box shows the same sequence as 282P1G03 v.1. SNPs are indicated above the box.

Figures 1, 11:
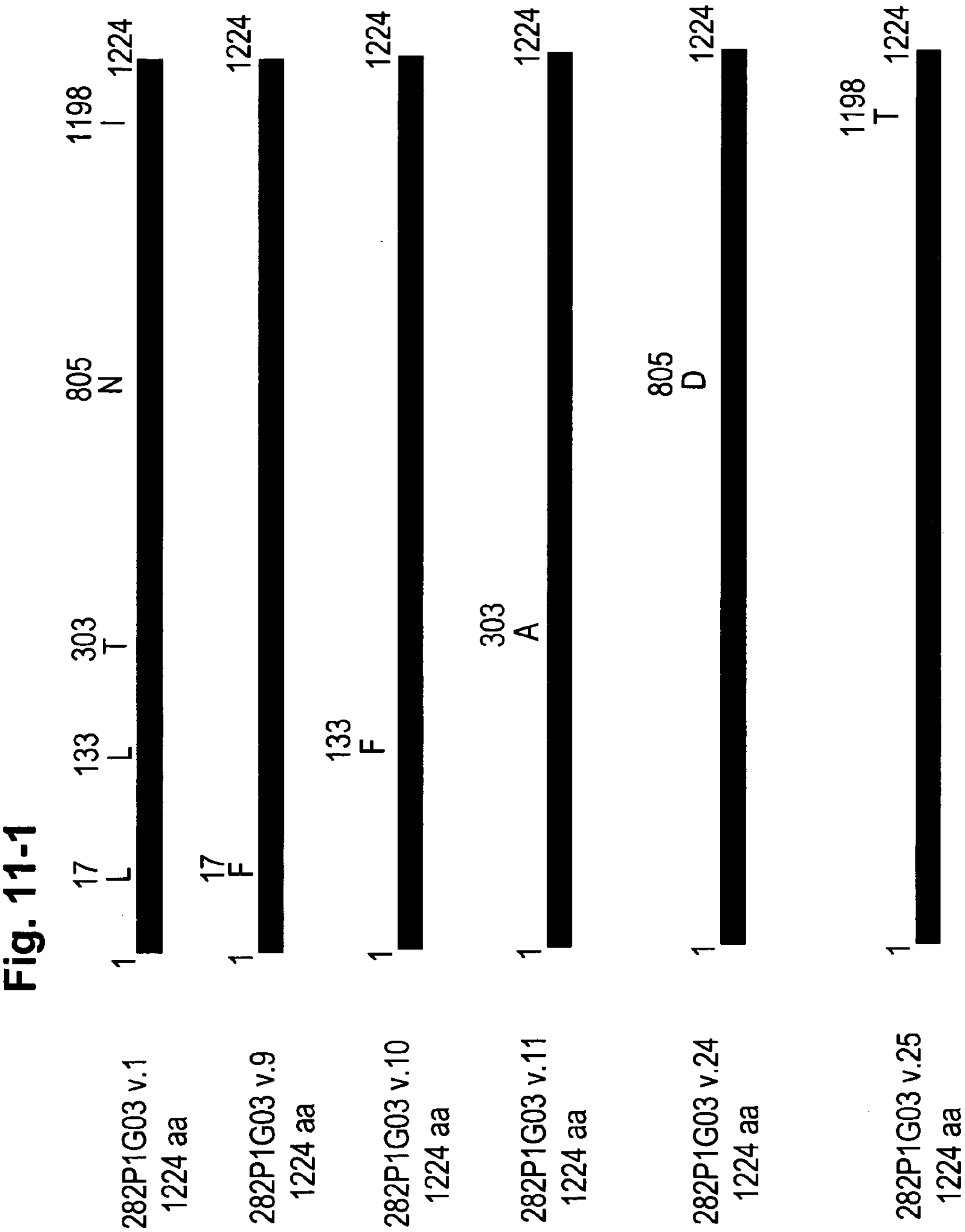
Figures 2, 11:
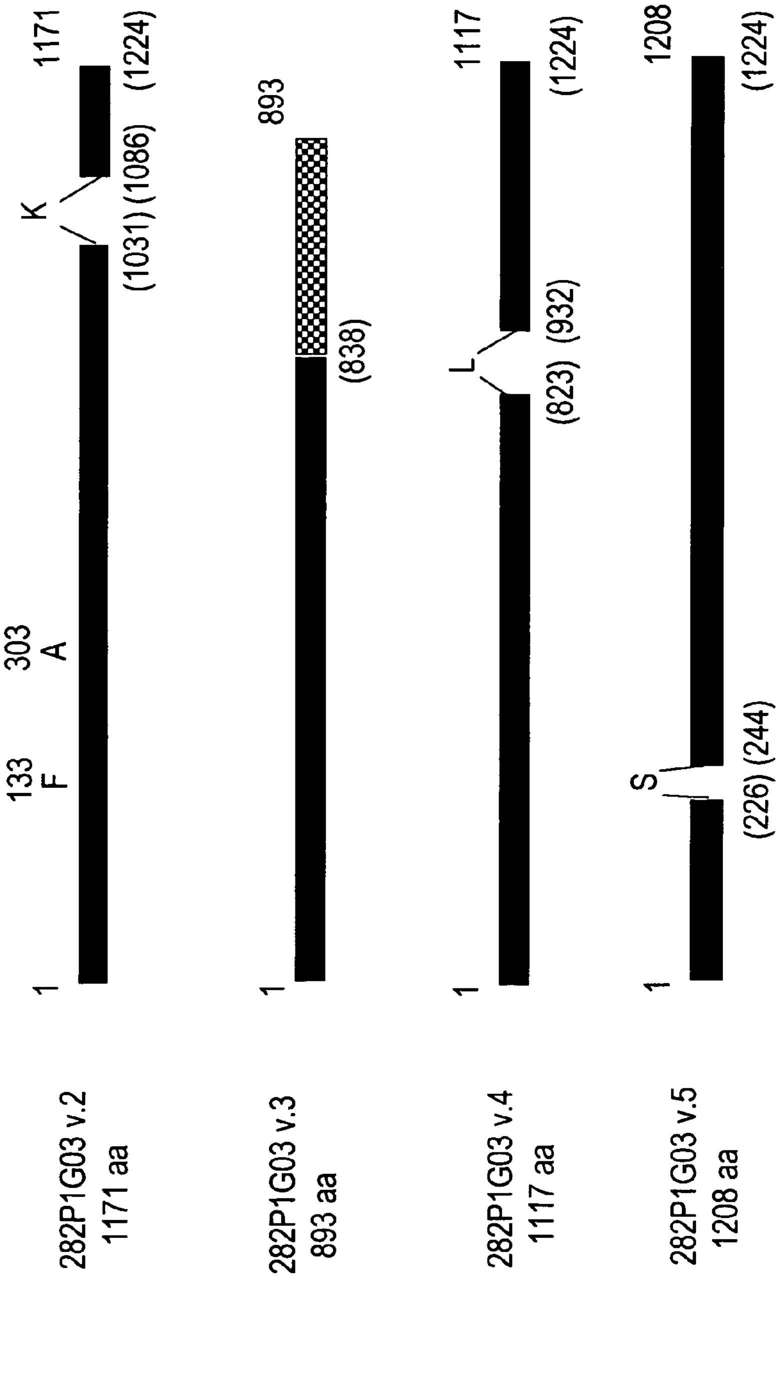
Figures 3, 11:
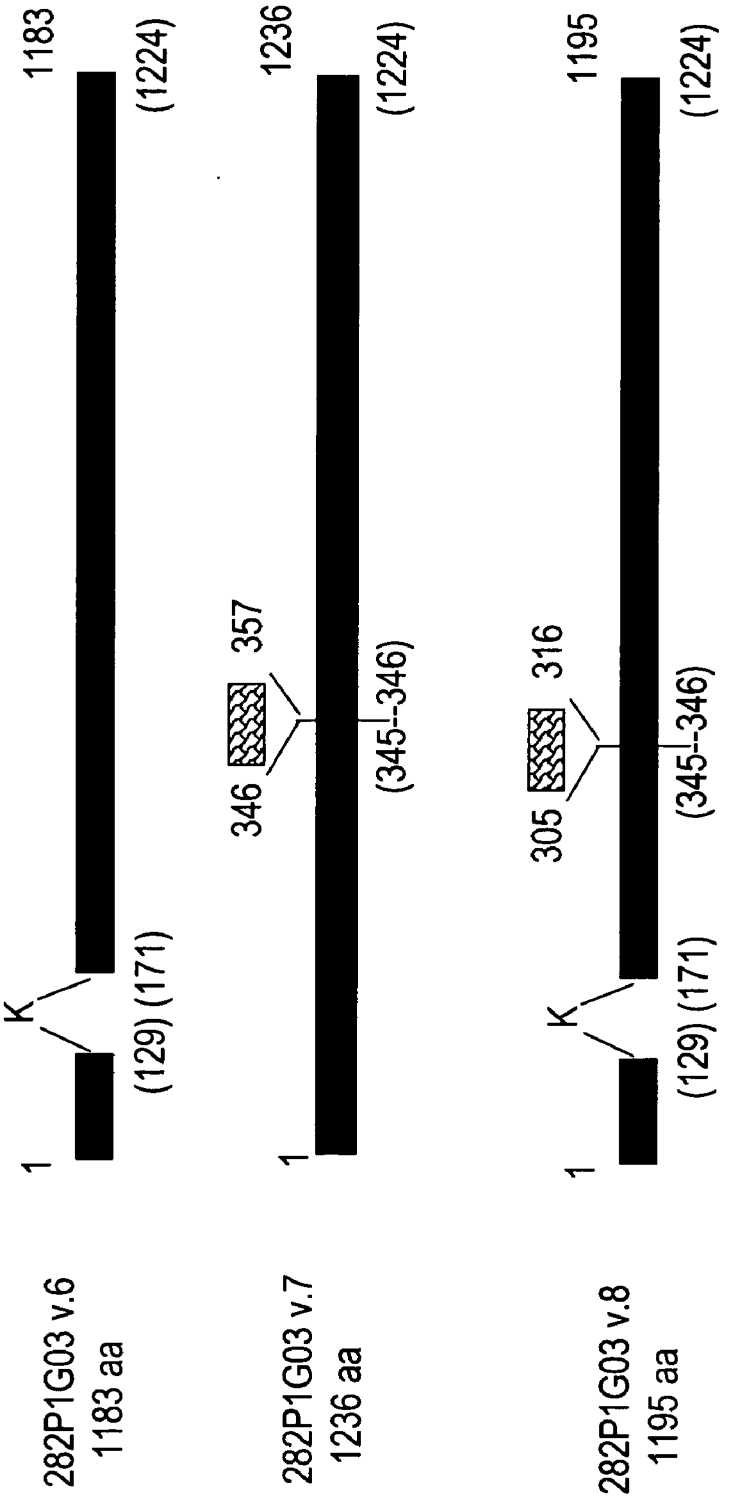

FIG. 11. Schematic alignment of protein variants of 282P1G03. Protein variants are named to correspond to nucleotide variants. Variants v.2 through v.8 were translated from splice variants. Variants v.7 and v.8 had an insertion of 12 amino acids. Variants v.9 through v.11, v.24, and v.25 were translated from SNP variants. Nucleotide variants 282P1G03 v.12 through v.23 coded for the same protein as v.1. Single amino acid differences among the proteins translated from SNP variants were indicated above the boxes. Black boxes represent the same sequence as 282P1G03 v.1. Numbers underneath the box correspond to positions in 282P1G03 v.1.

FIG. 12. Structures of transcript variants of 282P1G03. Variant 282P1G03 v.2 through v.8 and v.28 are transcript variants of 282P1G03 v.1. Variant 282P1G03 v.3 deleted exons 22 through 27, 3' portion of exon 21 and 5' portion of exon 28 of variant 282P1G03 v.1. Variants v.2, v.4, v.5 and v.6 spliced out exon 25, exons 21–22, exon 8, and exon 6, respectively, in v.1. Variant 282P1G03 v.7 extended 36 bp at the 5' end of exon 11 of variant 282P1G03 v.1. In addition to such an extension of 36 bp to exon 11 of v.1, variant 282P1G03 v.8 deleted exon 6 of variant 282P1G03 v.1. The 11th potential exon had two forms: the longer form was 36 bp longer than the shorter form. The 21st and 28th potential exons could also have a long and a short form, as seen in v. 3. Poly A tails are not shown here. Numbers in "( )" underneath the boxes correspond to those of 282P1G03 v.1. Lengths of introns and exons are not proportional.

FIG. 13. Secondary structure and transmembrane domains prediction for 282P1G3B protein variants. The secondary structure of 282P1G3B protein variants 1 through 8 (FIGS. 13A (SEQ ID NO: 199), 13B (SEQ ID NO: 200), 13C (SEQ ID NO: 201), 13D (SEQ ID NO: 202), 13E (SEQ ID NO: 203), 13F (SEQ ID NO: 204), 13G (SEQ ID NO: 205), and 13H (SEQ ID NO: 206) respectively) were predicted using the HNN—Hierarchical Neural Network method (NPS@: Network Protein Sequence Analysis TIBS 2000 March Vol. 25, No 3 [291]: 147–150 Combet C., Blanchet C., Geourjon C. and Deléage G., accessed from the ExPasy molecular biology server located on the World Wide Web. This method predicts the presence and location of alpha helices, extended strands, and random coils from the primary protein sequence. The percent of the protein in a given secondary structure is also listed.

FIGS. 13I, 13K, 13M, 13O, 13Q, 13S, 13U, and 13W: Show schematic representations of the probability of existence of transmembrane regions and orientation of 282P1G3B variants 1 through 9, respectively, based on the TMpred algorithm of Hofmann and Stoffel which utilizes TMBASE (K. Hofmann, W. Stoffel. TMBASE—A database of membrane spanning protein segments Biol. Chem. Hoppe-Seyler 374:166, 1993). FIGS. 13J, 13L, 13N, 13P, 13R, 13T, 13V, and 13X: Show schematic representations of the probability of the existence of transmembrane regions and the extracellular and intracellular orientation of 282P1G3B variants 1 through 9, respectively, based on the TMHMM algorithm of Sonnhammer, von Heijne, and Krogh (Erik L. L. Sonnhammer, Gunnar von Heijne, and Anders Krogh: A hidden Markov model for predicting transmembrane helices in protein sequences. In Proc. of Sixth Int. Conf. on Intelligent Systems for Molecular Biology, p 175–182 Ed J. Glasgow, T. Littlejohn, F. Major, R. Lathrop, D. Sankoff, and C. Sensen Menlo Park, Calif.: AAAI Press, 1998). The TMpred and TMHMM algorithms are accessed from the ExPasy molecular biology server located on the World Wide Web.

Figure 14B:
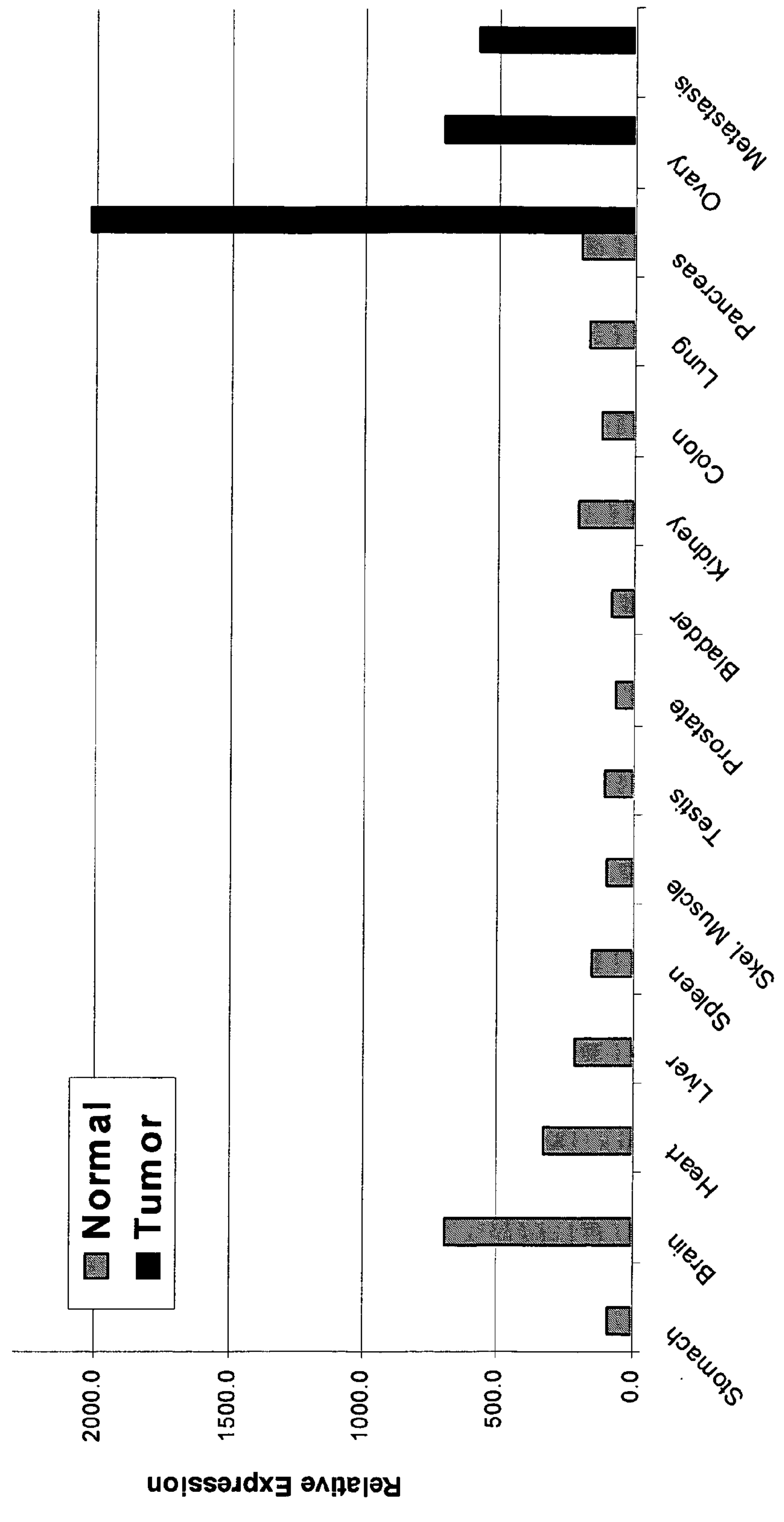

FIG. 14. 282P1G3 Expression by RT-PCR. First strand cDNA was prepared from (A) vital pool 1 (liver, lung and kidney), vital pool 2 (pancreas, colon and stomach), normal pancreas, ovary cancer pool, and pancreas cancer pool; (B) normal stomach, normal brain, normal heart, normal liver, normal skeletal muscle, normal testis, normal prostate, normal bladder, normal kidney, normal colon, normal lung, normal pancreas, and a pool of cancer specimens from pancreas cancer patients, ovary cancer patients, and cancer metastasis specimens. Normalization was performed by PCR using primers to actin. Semi-quantitative PCR, using primers to 282P1G3, was performed at 26 and 30 cycles of amplification. (A) Expression of 282P1G3 was detected in ovary cancer pool, pancreas cancer pool vital pool 1, but not in vital pool 2 nor in normal pancreas. (B) Samples were run on an agarose gel, and PCR products were quantitated using the Alphalmager software. Results show strong expression in pancreas cancer, ovary cancer, cancer metastasis, and normal brain compared to all other normal tissues tested.

FIG. 15. 282P1G3 expression in normal tissues. Two multiple tissue northern blots (Clontech) both with 2 ug of mRNA/lane were probed with the 282P1G3 sequence. Size standards in kilobases (kb) are indicated on the side. Results show expression of an approximately 9–10 kb 282P1G3 transcript in normal brain, but not in any other normal tissue tested.

FIG. 16. Expression of 282P1G3 in Pancreas Cancer Patient Specimens. RNA was extracted from pancreas cancer cell lines (CL), normal pancreas (N), and pancreas cancer patient tumor (T). Northern blots with 10 ug of total RNA were probed with the 282P1G3 DNA probe. Size standards in kilobases are on the side. Results show expression of 282P1G3 in pancreas cancer patient tumor specimen but not in the cell lines nor in the normal pancreas.

FIG. 17. Expression of 282P1G3 in Ovary Cancer Patient Specimens. RNA was extracted from ovary cancer cell lines (CL), normal ovary (N), and ovary cancer patient tumor (T). Northern blots with 10 ug of total RNA were probed with the 282P1G3 DNA probe. Size standards in kilobases are on the side. Results show expression of 282P1G3 in ovary cancer patient tumor specimen but not in the cell lines nor in the normal ovary.

FIG. 18. Expression of 282P1G3 in Lymphoma Cancer Patient Specimens. RNA was extracted from peripheral blood lymphocytes, cord blood isolated from normal individuals, and from lymphoma patient cancer specimens. Northern blots with 10 ug of total RNA were probed with the 282P1G3 sequence. Size standards in kilobases are on the side. Results show expression of 282P1G3 in lymphoma patient specimens but not in the normal blood cells tested.

FIG. 19. 282P1G3 Expression in 293T Cells Following Transfection of 282P1G3.pcDNA3.1/MycHis Construct. The complete ORF of 282P1G3 v.2 was cloned into the pcDNA3.1/MycHis construct to generate 282P1G3.pcDNA3.1/MycHis. 293T cells were transfected with either 282P1G3.pcDNA3.1/MycHis or pcDNA3.1/MycHis vector control. Forty hours later, cell lysates were collected. Samples were run on an SDS-PAGE acrylamide gel, blotted and stained with anti-his antibody. The blot was developed using the ECL chemiluminescence kit and visualized by autoradiography. Results show expression of 282P1G3 from the 282P1G3.pcDNA3.1/MycHis construct in the lysates of transfected cells.

FIG. 20. 282P1G3 Expression in 293T Cells Following Transfection of 282P1G3.pcDNA3.1/MycHis Construt. The extracellular domain, amino acids 26–1043, of 282P1G3 v.2 was cloned into the pTag5 construct to generate 282P1G3.pTag5. 293T cells were transfected with 282P1G3.pTag5 construct. Forty hours later, supernatant as well as cell lysates were collected. Samples were run on an SDS-PAGE acrylamide gel, blotted and stained with anti-his antibody. The blot was developed using the ECL chemiluminescence kit and visualized by autoradiography. Results show expression and secretion of 282P1G3 from the 282P1G3.pTag5 transfected cells.

DETAILED DESCRIPTION OF THE INVENTION

Outline of Sections

I.) Definitions
II.) 282P1G3 Polynucleotides
II.A.) Uses of 282P1G3 Polynucleotides
II.A.1.) Monitoring of Genetic Abnormalities
II.A.2.) Antisense Embodiments
II.A.3.) Primers and Primer Pairs
II.A.4.) Isolation of 282P1G3-Encoding Nucleic Acid Molecules
II.A.5.) Recombinant Nucleic Acid Molecules and Host-Vector Systems
III.) 282P1G3-related Proteins
III.A.) Motif-bearing Protein Embodiments
III.B.) Expression of 282P1G3-related Proteins
III.C.) Modifications of 282P1G3-related Proteins
III.D.) Uses of 282P1G3-related Proteins
IV.) 282P1G3 Antibodies
V.) 282P1G3 Cellular Immune Responses
VI.) 282P1G3 Transgenic Animals
VII.) Methods for the Detection of 282P1G3
VIII.) Methods for Monitoring the Status of 282P1G3-Related Genes and Their Products
IX.) Identification of Molecules That Interact With 282P1G3
X.) Therapeutic Methods and Compositions
X.A.) Anti-Cancer Vaccines
X.B.) 282P1G3 as a Target for Antibody-Based Therapy
X.C.) 282P1G3 as a Target for Cellular Immune Responses
X.C.1. Minigene Vaccines
X.C.2. Combinations of CTL Peptides with Helper Peptides
X.C.3. Combinations of CTL Peptides with T Cell Priming Agents
X.C.4. Vaccine Compositions Comprising DC Pulsed with CTL and/or HTL Peptides
X.D.) Adoptive Immunotherapy
X.E.) Administration of Vaccines for Therapeutic or Prophylactic Purposes
XI.) Diagnostic and Prognostic Embodiments of 282P1G3.
XII.) Inhibition of 282P1G3 Protein Function
XII.A.) Inhibition of 282P1G3 with Intracellular Antibodies
XII.B.) Inhibition of 282P1G3 with Recombinant Proteins
XII.C.) Inhibition of 282P1G3 Transcription or Translation
XII.D.) General Considerations for Therapeutic Strategies
XIII.) Identification, Characterization and Use of Modulators of 282P1G3
XIV.) KITS/Articles of Manufacture I.) Definitions Unless otherwise defined, all terms of art, notations and other scientific terms or terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a substanbal difference over what is generally understood in the art. Many of the techniques and procedures described or referenced herein are well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

The terms "advanced prostate cancer", "locally advanced prostate cancer", "advanced disease" and "locally advanced disease" mean prostate cancers that have extended through the prostate capsule, and are meant to include stage C disease under the American Urological Association (AUA) system, stage C1-C2 disease under the Whitmore-Jewelt system, and stage T3-T4 and N+ disease under the TNM (tumor, node, metastasis) system. In general, surgery is not recommended for patients with locally advanced disease, and these patients have substantially less favorable outcomes compared to patients having clinically localized (organ-confined) prostate cancer. Locally advanced disease is clinically identified by palpable evidence of induration beyond the lateral border of the prostate, or asymmetry or induration above the prostate base. Locally advanced prostate cancer is presently diagnosed pathologically following radical prostatectomy if the tumor invades or penetrates the prostatic capsule, extends into the surgical margin, or invades the seminal vesicles.

"Altering the native glycosylation pattern" is intended for purposes herein to mean deleting one or more carbohydrate moieties found in native sequence 282P1G3 (either by removing the underlying glycosylation site or by deleting the glycosylation by chemical and/or enzymatic means), and/or adding one or more glycosylation sites that are not present in the native sequence 282P1G3. In addition, the phrase includes qualitative changes in the glycosylation of the native proteins, involving a change in the nature and proportions of the various carbohydrate moieties present.

The term "analog" refers to a molecule which is structurally similar or shares similar or corresponding attributes with another molecule (e.g. a 282P1G3-related protein). For example, an analog of a 282P1G3 protein can be specifically bound by an antibody or T cell that specifically binds to 282P1G3.

The term "antibody" is used in the broadest sense. Therefore, an "antibody" can be naturally occurring or man-made such as monoclonal antibodies produced by conventional hybridoma technology. Anti-282P1G3 antibodies comprise monoclonal and polyclonal antibodies as well as fragments containing the antigen-binding domain and/or one or more complementarity determining regions of these antibodies.

An "antibody fragment" is defined as at least a portion of the variable region of the immunoglobulin molecule that binds to its target, i.e., the antigen-binding region. In one embodiment it specifically covers single anti-282P1G3 antibodies and clones thereof (including agonist, antagonist and neutralizing antibodies) and anti-282P1G3 antibody compositions with polyepitopic specificity.

The term "codon optimized sequences" refers to nucleotide sequences that have been optimized for a particular host species by replacing any codons having a usage frequency of less than about 20%. Nucleotide sequences that have been optimized for expression in a given host species by elimination of spurious polyadenylation sequences, elimination of exon/intron splicing signals, elimination of transposon-like repeats and/or optimization of GC content in addition to codon optimization are referred to herein as an "expression enhanced sequences."

A "combinatorial library" is a collection of diverse chemical compounds generated by either chemical synthesis or biological synthesis by combining a number of chemical "building blocks" such as reagents. For example, a linear combinatorial chemical library, such as a polypeptide (e.g., mutein) library, is formed by combining a set of chemical building blocks called amino acids in every possible way for a given compound length (i.e., the number of amino acids in a polypeptide compound). Numerous chemical compounds are synthesized through such combinatorial mixing of chemical building blocks (Gallop et al., J. Med. Chem. 37(9): 1233–1251 (1994)).

Preparation and screening of combinatorial libraries is well known to those of skill in the art. Such combinatorial chemical libraries include, but are not limited to, peptide libraries (see, e.g., U.S. Pat. No. 5,010,175, Furka, Pept. Prot. Res. 37:487–493 (1991), Houghton et al., Nature, 354:84–88 (1991)), peptoids (PCT Publication No WO 91/91735), encoded peptides (PCT Publication WO 93/20242), random bio-oligomers (PCT Publication WO 92/00091), benzodiazepines (U.S. Pat. No. 5,288,514), diversomers such as hydantoins, benzodiazepines and dipeptides (Hobbs et al., Proc. Nat. Acad. Sci. USA 90:6909–6913 (1993)), vinylogous polypeptides (Hagihara et al., J. Amer. Chem. Soc. 114:6568 (1992)), nonpeptidal peptidomimetics with a Beta-D-Glucose scaffolding (Hirschmann et al., J. Amer. Chem. Soc. 114:9217–9218 (1992)), analogous organic syntheses of small compound libraries (Chen et al., J. Amer. Chem. Soc. 116:2661 (1994)), oligocarbarnates (Cho, et al., Science 261:1303 (1993)), and/or peptidyl phosphonates (Campbell et al., J. Org. Chem. 59:658 (1994)). See, generally, Gordon et al., J. Med. Chem. 37:1385 (1994), nucleic acid libraries (see, e.g., Stratagene, Corp.), peptide nucleic acid libraries (see, e.g., U.S. Pat. No. 5,539,083), antibody libraries (see, e.g., Vaughn et al., Nature Biotechnology 14(3): 309–314 (1996), and PCT/US96/10287), carbohydrate libraries (see, e.g., Liang et al., Science 274:1520–1522 (1996), and U.S. Pat. No. 5,593,853), and small organic molecule libraries (see, e.g., benzodiazepines, Baum, C&EN, January 18, page 33 (1993); isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337; benzodiazepines, U.S. Pat. No. 5,288,514; and the like).

Devices for the preparation of combinatorial libraries are commercially available (see, e.g., 357 NIPS, 390 NIPS, Advanced Chem Tech, Louisville Ky.; Symphony, Rainin, Woburn, Mass.; 433A, Applied Biosystems, Foster City, Calif.; 9050, Plus, Millipore, Bedford, NIA). A number of well-known robotic systems have also been developed for solution phase chemistries. These systems include automated workstations such as the automated synthesis apparatus developed by Takeda Chemical Industries, LTD. (Osaka, Japan) and many robotic systems utilizing robotic arms (Zymate H, Zymark Corporation, Hopkinton, Mass.; Orca, Hewlett-Packard, Palo Alto, Calif.), which mimic the manual synthetic operations performed by a chemist. Any of the above devices are suitable for use with the present invention. The nature and implementation of modifications to these devices (if any) so that they can operate as discussed herein will be apparent to persons skilled in the relevant art. In addition, numerous combinatorial libraries are themselves commercially available (see, e.g., ComGenex, Princeton, N.J.; Asinex, Moscow, RU; Tripos, Inc., St. Louis, Mo.; ChemStar, Ltd, Moscow, RU; 3D Pharmaceuticals, Exton, Pa.; Martek Biosciences, Columbia, Md.; etc.).

The term "cytotoxic agent" refers to a substance that inhibits or prevents the expression activity of cells, function of cells and/or causes destruction of cells. The term is intended to include radioactive isotopes chemotherapeutic agents, and toxins such as small molecule toxins or enzymatically active toxins of bacterial, fungal, plant or animal origin, including fragments and/or variants thereof. Examples of cytotoxic agents include, but are not limited to auristatins, auromycins, maytansinoids, yttrium, bismuth, ricin, ricin A-chain, combrestatin, duocarmycins, dolostatins, doxorubicin, daunorubicin, taxol, cisplatin, cc1065, ethidium bromide, mitomycin, etoposide, tenoposide, vincristine, vinblastine, colchicine, dihydroxy anthracin dione, actinomycin, diphtheria toxin, *Pseudomonas* exotoxin (PE) A, PE40, abrin, abrin A chain, modeccin A chain, alpha-sarcin, gelonin, mitogellin, retstrictocin, phenomycin, enomycin, curicin, crotin, calicheamicin, *Sapaonaria officinalis* inhibitor, and glucocorticoid and other chemotherapeutic agents, as well as radioisotopes such as $At^{211}$, $I^{131}$, $I^{125}$, $Y^{90}$, $Re^{186}$, $Re^{188}$, $Sm^{153}$, $Bi^{212}$ or 213, $P^{32}$ and radioactive isotopes of Lu including $Lu^{177}$. Antibodies may also be conjugated to an anti-cancer pro-drug activating enzyme capable of converting the pro-drug to its active form.

The "gene product" is sometimes referred to herein as a protein or mRNA. For example, a "gene product of the invention" is sometimes referred to herein as a "cancer amino acid sequence", "cancer protein", "protein of a cancer listed in Table I", a "cancer mRNA", "mRNA of a cancer listed in Table I", etc. In one embodiment, the cancer protein is encoded by a nucleic acid of FIG. 2. The cancer protein can be a fragment, or alternatively, be the full-length protein to the fragment encoded by the nucleic acids of FIG. 2. In one embodiment, a cancer amino acid sequence is used to determine sequence identity or similarity. In another embodiment, the sequences are naturally occurring allelic variants of a protein encoded by a nucleic acid of FIG. 2. In another embodiment, the sequences are sequence variants as further described herein.

"High throughput screening" assays for the presence, absence, quantification, or other properties of particular nucleic acids or protein products are well known to those of skill in the art. Similarly, binding assays and reporter gene assays are similarly well known. Thus, e.g., U.S. Pat. No. 5,559,410 discloses high throughput screening methods for proteins; U.S. Pat. No. 5,585,639 discloses high throughput screening methods for nucleic acid binding (i.e., in arrays); while U.S. Pat. Nos. 5,576,220 and 5,541,061 disclose high throughput methods of screening for ligand/antibody binding.

In addition, high throughput screening systems are commercially available (see, e.g., Amersham Biosciences, Piscataway, N.J.; Zymark Corp., Hopkinton, Mass.; Air Technical Industries, Mentor, Ohio; Beckman Instruments, Inc. Fullerton, Calif.; Precision Systems, Inc., Natick, Mass.; etc.). These systems typically automate entire procedures, including all sample and reagent pipetting, liquid dispensing, timed incubations, and final readings of the microplate in detector(s) appropriate for the assay. These configurable systems provide high throughput and rapid start up as well as a high degree of flexibility and customization. The manufacturers of such systems provide detailed protocols for various high throughput systems. Thus, e.g., Zymark Corp. provides technical bulletins describing screening systems for detecting the modulation of gene transcription, ligand binding, and the like.

The term "homolog" refers to a molecule which exhibits homology to another molecule, by for example, having sequences of chemical residues that are the same or similar at corresponding positions.

"Human Leukocyte Antigen" or "HLA" is a human class I or class II Major Histocompatibility Complex (MHC) protein (see, e.g., Stites, et al., IMMUNOLOGY, $8^{TH}$ ED., Lange Publishing, Los Altos, Calif. (1994).

The terms "hybridize", "hybridizing", "hybridizes" and the like, used in the context of polynucleotides, are meant to refer to conventional hybridization conditions, preferably such as hybridization in 50% formamide/6×SSC/0.1% SDS/100 μg/ml ssDNA, in which temperatures for hybridization are above 37 degrees C. and temperatures for washing in 0.1×SSC/0.1% SDS are above 55 degrees C.

The phrases "isolated" or "biologically pure" refer to material which is substantially or essentially free from components which normally accompany the material as it is found in its native state. Thus, isolated peptides in accordance with the invention preferably do not contain materials normally associated with the peptides in their in situ environment. For example, a polynucleotide is said to be "isolated" when it is substantially separated from contaminant polynucleotides that correspond or are complementary to genes other than the 282P1G3 genes or that encode polypeptides other than 282P1G3 gene product or fragments thereof. A skilled artisan can readily employ nucleic acid isolation procedures to obtain an isolated 282P1G3 polynucleotide. A protein is said to be "isolated," for example, when physical, mechanical or chemical methods are employed to remove the 282P1G3 proteins from cellular constituents that are normally associated with the protein. A skilled artisan can readily employ standard purification methods to obtain an isolated 282P1G3 protein. Alternatively, an isolated protein can be prepared by chemical means.

The term "mammal" refers to any organism classified as a mammal, including mice, rats, rabbits, dogs, cats, cows, horses and humans. In one embodiment of the invention, the mammal is a mouse. In another embodiment of the invention, the mammal is a human.

The terms "metastatic prostate cancer" and "metastatic disease" mean prostate cancers that have spread to regional lymph nodes or to distant sites, and are meant to include stage D disease under the AUA system and stage T×N×M+ under the TNM system. As is the case with locally advanced prostate cancer, surgery is generally not indicated for patients with metastatic disease, and hormonal (androgen ablation) therapy is a preferred treatment modality. Patients with metastatic prostate cancer eventually develop an androgen-refractory state within 12 to 18 months of treatment initiation. Approximately half of these androgen-refractory patients die within 6 months after developing that status. The most common site for prostate cancer metastasis is bone. Prostate cancer bone metastases are often osteoblastic rather than osteolytic (i.e., resulting in net bone formation). Bone metastases are found most frequently in the spine, followed by the femur, pelvis, rib cage, skull and humerus. Other common sites for metastasis include lymph nodes, lung, liver and brain. Metastatic prostate cancer is typically diagnosed by open or laparoscopic pelvic lymphadenectomy, whole body radionuclide scans, skeletal radiography, and/or bone lesion biopsy.

The term "modulator" or "test compound" or "drug candidate" or grammatical equivalents as used herein describe any molecule, e.g., protein, oligopeptide, small organic molecule, polysaccharide, polynucleotide, etc., to be tested for the capacity to directly or indirectly alter the cancer phenotype or the expression of a cancer sequence, e.g., a nucleic acid or protein sequences, or effects of cancer sequences (e.g., signaling, gene expression, protein interaction, etc.) In one aspect, a modulator will neutralize the effect of a cancer protein of the invention. By "neutralize" is meant that an activity of a protein is inhibited or blocked, along with the consequent effect on the cell. In another aspect, a modulator will neutralize the effect of a gene, and its corresponding protein, of the invention by normalizing levels of said protein. In preferred embodiments, modulators alter expression profiles, or expression profile nucleic acids or proteins provided herein, or downstream effector pathways. In one embodiment, the modulator suppresses a cancer phenotype, e.g. to a normal tissue fingerprint. In another embodiment, a modulator induced a cancer phenotype. Generally, a plurality of assay mixtures is run in parallel with different agent concentrations to obtain a differential response to the various concentrations. Typically, one of these concentrations serves as a negative control, i.e., at zero concentration or below the level of detection.

Modulators, drug candidates or test compounds encompass numerous chemical classes, though typically they are organic molecules, preferably small organic compounds having a molecular weight of more than 100 and less than about 2,500 Daltons. Preferred small molecules are less than 2000, or less than 1500 or less than 1000 or less than 500 D. Candidate agents comprise functional groups necessary for structural interaction with proteins, particularly hydrogen bonding, and typically include at least an amine, carbonyl, hydroxyl or carboxyl group, preferably at least two of the functional chemical groups. The candidate agents often comprise cyclical carbon or heterocyclic structures and/or aromatic or polyaromatic structures substituted with one or more of the above functional groups. Modulators also comprise biomolecules such as peptides, saccharides, fatty acids, steroids, purines, pyrimidines, derivatives, structural analogs or combinations thereof. Particularly preferred are peptides. One class of modulators are peptides, for example of from about five to about 35 amino acids, with from about five to about 20 amino acids being preferred, and from about 7 to about 15 being particularly preferred. Preferably, the cancer modulatory protein is soluble, includes a non-transmembrane region, and/or, has an N-terminal Cys to aid in solubility. In one embodiment, the C-terminus of the fragment is kept as a free acid and the N-terminus is a free amine to aid in coupling, i.e., to cysteine. In one embodiment, a cancer protein of the invention is conjugated to an immunogenic agent as discussed herein. In one embodiment, the cancer protein is conjugated to BSA. The peptides of the invention, e.g., of preferred lengths, can be linked to each other or to other amino acids to create a longer peptide/protein. The modulatory peptides can be digests of naturally occurring proteins as is outlined above, random peptides, or "biased" random peptides. In a preferred embodiment, peptide/protein-based modulators are antibodies, and fragments thereof, as defined herein.

Modulators of cancer can also be nucleic acids. Nucleic acid modulating agents can be naturally occurring nucleic acids, random nucleic acids, or "biased" random nucleic acids. For example, digests of prokaryotic or eukaryotic genomes can be used in an approach analogous to that outlined above for proteins.

The term "monoclonal antibody" refers to an antibody obtained from a population of substantially homogeneous antibodies, i.e., the antibodies comprising the population are identical except for possible naturally occurring mutations that are present in minor amounts.

A "motif", as in biological motif of a 282P1G3-related protein, refers to any pattern of amino acids forming part of the primary sequence of a protein, that is associated with a particular function (e.g. protein-protein interaction, protein-DNA interaction, etc) or modification (e.g. that is phosphorylated, glycosylated or amidated), or localization (e.g. secretory sequence, nuclear localization sequence, etc.) or a sequence that is correlated with being immunogenic, either humorally or cellularly. A motif can be either contiguous or capable of being aligned to certain positions that are generally correlated with a certain function or property. In the context of HLA motifs, "motif" refers to the pattern of residues in a peptide of defined length, usually a peptide of from about 8 to about 13 amino acids for a class I HLA motif and from about 6 to about 25 amino acids for a class II HLA motif, which is recognized by a particular HLA molecule. Peptide motifs for HLA binding are typically different for each protein encoded by each human HLA allele and differ in the pattern of the primary and secondary anchor residues.

A "pharmaceutical excipient" comprises a material such as an adjuvant, a carrier, pH-adjusting and buffering agents, tonicity adjusting agents, wetting agents, preservative, and the like.

"Pharmaceutically acceptable" refers to a non-toxic, inert, and/or composition that is physiologically compatible with humans or other mammals.

The term "polynucleotide" means a polymeric form of nucleotides of at least 10 bases or base pairs in length, either ribonucleotides or deoxynucleotides or a modified form of either type of nucleotide, and is meant to include single and double stranded forms of DNA and/or RNA. In the art, this term if often used interchangeably with "oligonucleotide". A polynucleotide can comprise a nucleotide sequence disclosed herein wherein thymidine (T), as shown for example in FIG. 2, can also be uracil (U); this definition pertains to the differences between the chemical structures of DNA and RNA, in particular the observation that one of the four major bases in RNA is uracil (U) instead of thymidine (T).

The term "polypeptide" means a polymer of at least about 4, 5, 6, 7, or 8 amino acids. Throughout the specification, standard three letter or single letter designations for amino acids are used. In the art, this term is often used interchangeably with "peptide" or "protein".

An HLA "primary anchor residue" is an amino acid at a specific position along a peptide sequence which is understood to provide a contact point between the immunogenic peptide and the HLA molecule. One to three, usually two, primary anchor residues within a peptide of defined length generally defines a "motif" for an immunogenic peptide. These residues are understood to fit in close contact with peptide binding groove of an HLA molecule, with their side chains buried in specific pockets of the binding groove. In one embodiment, for example, the primary anchor residues for an HLA class I molecule are located at position 2 (from the amino terminal position) and at the carboxyl terminal position of a 8, 9, 10, 11, or 12 residue peptide epitope in accordance with the invention. Alternatively, in another embodiment, the primary anchor residues of a peptide binds an HLA class II molecule are spaced relative to each other, rather than to the termini of a peptide, where the peptide is generally of at least 9 amino acids in length. The primary anchor positions for each motif and supermotif are set forth in Table IV. For example, analog peptides can be created by altering the presence or absence of particular residues in the primary and/or secondary anchor positions shown in Table IV. Such analogs are used to modulate the binding affinity and/or population coverage of a peptide comprising a particular HLA motif or supermotif.

"Radioisotopes" include, but are not limited to the following (non-limiting exemplary uses are also set forth):

Examples of Medical Isotopes:

| Isotope | Description of use |
|---|---|
| Actinium-225 (AC-225) | See Thorium-229 (Th-229) |

-continued

| Isotope | Description of use |
|---|---|
| Actinium-227 (AC-227) | Parent of Radium-223 (Ra-223) which is an alpha emitter used to treat metastases in the skeleton resulting from cancer (i.e., breast and prostate cancers), and cancer radioimmunotherapy |
| Bismuth-212 (Bi-212) | See Thorium-228 (Th-228) |
| Bismuth-213 (Bi-213) | See Thorium-229 (Th-229) |
| Cadmium-109 (Cd-109) | Cancer detection |
| Cobalt-60 (Co-60) | Radiation source for radiotherapy of cancer, for food irradiators, and for sterilization of medical supplies |
| Copper-64 (Cu-64) | A positron emitter used for cancer therapy and SPECT imaging |
| Copper-67 (Cu-67) | Beta/gamma emitter used in cancer radioimmunotherapy and diagnostic studies (i.e., breast and colon cancers, and lymphoma) |
| Dysprosium-166 (Dy-166) | Cancer radioimmunotherapy |
| Erbium-169 (Er-169) | Rheumatoid arthritis treatment, particularly for the small joints associated with fingers and toes |
| Europium-152 (Eu-152) | Radiation source for food irradiation and for sterilization of medical supplies |
| Europium-154 (Eu-154) | Radiation source for food irradiation and for sterilization of medical supplies |
| Gadolinium-153 (Gd-153) | Osteoporosis detection and nuclear medical quality assurance devices |
| Gold-198 (Au-198) | Implant and intracavity therapy of ovarian, prostate, and brain cancers |
| Holmium-166 (Ho-166) | Multiple myeloma treatment in targeted skeletal therapy, cancer radioimmunotherapy, bone marrow ablation, and rheumatoid arthritis treatment |
| Iodine-125 (I-125) | Osteoporosis detection, diagnostic imaging, tracer drugs, brain cancer treatment, radiolabeling, tumor imaging, mapping of receptors in the brain, interstitial radiation therapy, brachytherapy for treatment of prostate cancer, determination of glomerular filtration rate (GFR), determination of plasma volume, detection of deep vein thrombosis of the legs |
| Iodine-131 (I-131) | Thyroid function evaluation, thyroid disease detection, treatment of thyroid cancer as well as other non-malignant thyroid diseases (i.e., Graves disease, goiters, and hyperthyroidism), treatment of leukemia, lymphoma, and other forms of cancer (e.g., breast cancer) using radioimmunotherapy |
| Iridium-192 (Ir-192) | Brachytherapy, brain and spinal cord tumor treatment, treatment of blocked arteries (i.e., arteriosclerosis and restenosis), and implants for breast and prostate tumors |
| Lutetium-177 (Lu-177) | Cancer radioimmunotherapy and treatment of blocked arteries (i.e., arteriosclerosis and restenosis) |
| Molybdenum-99 (Mo-99) | Parent of Technetium-99m (Tc-99m) which is used for imaging the brain, liver, lungs, heart, and other organs. Currently, Tc-99m is the most widely used radioisotope used for diagnostic imaging of various cancers and diseases involving the brain, heart, liver, lungs; also used in detection of deep vein thrombosis of the legs |
| Osmium-194 (Os-194) | Cancer radioimmunotherapy |
| Palladium-103 (Pd-103) | Prostate cancer treatment |
| Platinum-195m (Pt-195m) | Studies on biodistribution and metabolism of cisplatin, a chemotherapeutic drug |
| Phosphorus-32 (P-32) | Polycythemia rubra vera (blood cell disease) and leukemia treatment, bone cancer diagnosis/treatment; colon, pancreatic, and liver cancer treatment; radiolabeling nucleic acids for in vitro research, diagnosis of superficial tumors, treatment of blocked arteries (i.e., arteriosclerosis and restenosis), and intracavity therapy |
| Phosphorus-33 (P-33) | Leukemia treatment, bone disease diagnosis/treatment, radiolabeling, and treatment of blocked arteries (i.e., arteriosclerosis and restenosis) |
| Radium-223 (Ra-223) | See Actinium-227 (Ac-227) |
| Rhenium-186 (Re-186) | Bone cancer pain relief, rheumatoid arthritis treatment, and diagnosis and treatment of lymphoma and bone, breast, colon, and liver cancers using radioimmunotherapy |
| Rhenium-188 (Re-188) | Cancer diagnosis and treatment using radioimmunotherapy, bone cancer pain relief, treatment of rheumatoid arthritis, and treatment of prostate cancer |
| Rhodium-105 (Rh-105) | Cancer radioimmunotherapy |
| Samarium-145 (Sm-145) | Ocular cancer treatment |
| Samarium-153 (Sm-153) | Cancer radioimmunotherapy and bone cancer pain relief |
| Scandium-47 (Sc-47) | Cancer radioimmunotherapy and bone cancer pain relief |
| Selenium-75 (Se-75) | Radiotracer used in brain studies, imaging of adrenal cortex by gamma-scintigraphy, lateral locations of steroid secreting tumors, pancreatic scanning, detection of hyperactive parathyroid glands, measure rate of bile acid loss from the endogenous pool |
| Strontium-85 (Sr-85) | Bone cancer detection and brain scans |

-continued

| Isotope | Description of use |
|---|---|
| Strontium-89 (Sr-89) | Bone cancer pain relief, multiple myeloma treatment, and osteoblastic therapy |
| Technetium-99m (Tc-99m) | See Molybdenum-99 (Mo-99) |
| Thorium-228 (Th-228) | Parent of Bismuth-212 (Bi-212) which is an alpha emitter used in cancer radioimmunotherapy |
| Thorium-229 (Th-229) | Parent of Actinium-225 (Ac-225) and grandparent of Bismuth-213 (Bi-213) which are alpha emitters used in cancer radioimmunotherapy |
| Thulium-170 (Tm-170) | Gamma source for blood irradiators, energy source for implanted medical devices |
| Tin-117m (Sn-117m) | Cancer immunotherapy and bone cancer pain relief |
| Tungsten-188 (W-188) | Parent for Rhenium-188 (Re-188) which is used for cancer diagnostics/treatment, bone cancer pain relief, rheumatoid arthritis treatment, and treatment of blocked arteries (i.e., arteriosclerosis and restenosis) |
| Xenon-127 (Xe-127) | Neuroimaging of brain disorders, high resolution SPECT studies, pulmonary function tests, and cerebral blood flow studies |
| Ytterbium-175 (Yb-175) | Cancer radioimmunotherapy |
| Yttrium-90 (Y-90) | Microseeds obtained from irradiating Yttrium-89 (Y-89) for liver cancer treatment |
| Yttrium-91 (Y-91) | A gamma-emitting label for Yttrium-90 (Y-90) which is used for cancer radioimmunotherapy (i.e., lymphoma, breast, colon, kidney, lung, ovarian, prostate, pancreatic, and inoperable liver cancers) |

By "randomized" or grammatical equivalents as herein applied to nucleic acids and proteins is meant that each nucleic acid and peptide consists of essentially random nucleotides and amino acids, respectively. These random peptides (or nucleic acids, discussed herein) can incorporate any nucleotide or amino acid at any position. The synthetic process can be designed to generate randomized proteins or nucleic acids, to allow the formation of all or most of the possible combinations over the length of the sequence, thus forming a library of randomized candidate bioactive proteinaceous agents.

In one embodiment, a library is "fully randomized," with no sequence preferences or constants at any position. In another embodiment, the library is a "biased random" library. That is, some positions within the sequence either are held constant, or are selected from a limited number of possibilities. For example, the nucleotides or amino acid residues are randomized within a defined class, e.g., of hydrophobic amino acids, hydrophilic residues, sterically biased (either small or large) residues, towards the creation of nucleic acid binding domains, the creation of cysteines, for cross-linking, prolines for SH-3 domains, serines, threonines, tyrosines or histidines for phosphorylation sites, etc., or to purines, etc.

A "recombinant" DNA or RNA molecule is a DNA or RNA molecule that has been subjected to molecular manipulation in vitro.

Non-limiting examples of small molecules include compounds that bind or interact with 282P1G3, ligands including hormones, neuropeptides, chemokines, odorants, phospholipids, and functional equivalents thereof that bind and preferably inhibit 282P1G3 protein function. Such non-limiting small molecules preferably have a molecular weight of less than about 10 kDa, more preferably below about 9, about 8, about 7, about 6, about 5 or about 4 kDa. In certain embodiments, small molecules physically associate with, or bind, 282P1G3 protein; are not found in naturally occurring metabolic pathways; and/or are more soluble in aqueous than non-aqueous solutions "Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured nucleic acid sequences to reanneal when complementary strands are present in an environment below their melting temperature. The higher the degree of desired homology between the probe and hybridizable sequence, the higher the relative temperature that can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology, Wiley Interscience Publishers, (1995).

"Stringent conditions" or "high stringency conditions", as defined herein, are identified by, but not limited to, those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 μg/ml), 0.1% SDS, and 10% dextran sulfate at 42° C., with washes at 42° C. in 0.2×SSC (sodium chloride/sodium. citrate) and 50% formamide at 55° C., followed by a high-stringency wash consisting of 0.1×SSC containing EDTA at 55° C. "Moderately stringent conditions" are described by, but not limited to, those in Sambrook et al., Molecular Cloning: A Laboratory Manual, New York: Cold Spring Harbor Press, 1989, and include the use of washing solution and hybridization conditions (e.g., temperature, ionic strength and % SDS) less stringent than those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5× Denhardt's solution, 10% dextran sulfate, and 20 mg/mL denatured sheared salmon sperm DNA, followed by washing the filters in 1×SSC at about 37–50° C. The skilled artisan will recognize how to adjust the temperature, ionic strength, etc. as necessary to accommodate factors such as probe length and the like.

An HLA "supermotif" is a peptide binding specificity shared by HLA molecules encoded by two or more HLA alleles. Overall phenotypic frequencies of HLA-supertypes in different ethnic populations are set forth in Table IV (F). The non-limiting constituents of various supetypes are as follows:

A2: A*0201, A*0202, A*0203, A*0204, A*0205, A*0206, A*6802, A*6901, A*0207

A3: A3, A11, A31, A*3301, A*6801, A*0301, A*1101, A*3101

B7: B7, B*3501–03, B*51, B*5301, B*5401, B*5501, B*5502, B*5601, B*6701, B*7801, B*0702, B*5101, B*5602

B44: B*3701, B*4402, B*4403, B*60 (B*4001), B61 (B*4006)

A1: A*0102, A*2604, A*3601, A*4301, A*8001

A24: A*24, A*30, A*2403, A*2404, A*3002, A*3003

B27: B*1401–02, B*1503, B*1509, B*1510, B*1518, B*3801–02, B*3901, B*3902, B*3903–04, B*4801–02, B*7301, B*2701-08

B58: B*1516, B*1517, B*5701, B*5702, B58

B62: B*4601, B52, B*1501 (B62), B*1502 (B75), B*1513 (B77) Calculated population coverage afforded by different HLA-supertype combinations are set forth in Table IV (G).

As used herein "to treat" or "therapeutic" and grammatically related terms, refer to any improvement of any consequence of disease, such as prolonged survival, less morbidity, and/or a lessening of side effects which are the byproducts of an alternative therapeutic modality; full eradication of disease is not required.

A "transgenic animal" (e.g., a mouse or rat) is an animal having cells that contain a transgene, which transgene was introduced into the animal or an ancestor of the animal at a prenatal, e.g., an embryonic stage. A "transgene" is a DNA that is integrated into the genome of a cell from which a transgenic animal develops.

As used herein, an HLA or cellular immune response "vaccine" is a composition that contains or encodes one or more peptides of the invention. There are numerous embodiments of such vaccines, such as a cocktail of one or more individual peptides; one or more peptides of the invention comprised by a polyepitopic peptide; or nucleic acids that encode such individual peptides or polypeptides, e.g., a minigene that encodes a polyepitopic peptide. The "one or more peptides" can include any whole unit integer from 1–150 or more, e.g., at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 105, 110, 115, 120, 125, 130, 135, 140, 145, or 150 or more peptides of the invention. The peptides or polypeptides can optionally be modified, such as by lipidation, addition of targeting or other sequences. HLA class I peptides of the invention can be admixed with, or linked to, HLA class II peptides, to facilitate activation of both cytotoxic T lymphocytes and helper T lymphocytes. HLA vaccines can also comprise peptide-pulsed antigen presenting cells, e.g., dendritic cells.

The term "vanant" refers to a molecule that exhibits a variation from a described type or norm, such as a protein that has one or more different amino add residues in the corresponding position(s) of a specifically described protein (e.g. the 282P1G3 protein shown in FIG. 2 or FIG. 3. An analog is an example of a variant protein. Splice isoforms and single nucleotides polymorphisms (SNPs) are further examples of variants.

The "282P1G3-related proteins" of the invention include those specifically identified herein, as well as allelic variants, conservative substitution variants, analogs and homologs that can be isolated/generated and characterized without undue experimentation following the methods outlined herein or readily available in the art. Fusion proteins that combine parts of different 282P1G3 proteins or fragments thereof, as well as fusion proteins of a 282P1G3 protein and a heterologous polypeptide are also included. Such 282P1G3 proteins are collectively referred to as the 282P1G3-related proteins, the proteins of the invention, or 282P1G3. The term "282P1G3-related protein" refers to a polypeptide fragment or a 282P1G3 protein sequence of 4, 5, 6, 7, 8, 9, 10, 11, 12, 13, 14, 15, 16, 17, 18, 19, 20, 21, 22, 23, 24, 25, or more than 25 amino acids; or, at least 30, 35, 40, 45, 50, 55, 60, 65, 70, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, or 576 or more amino acids.

II.) 282P1G3 Polynucleotides

One aspect of the invention provides polynucleotides corresponding or complementary to all or part of a 282P1G3 gene, mRNA, and/or coding sequence, preferably in isolated form, including polynucleotides encoding a 282P1G3-related protein and fragments thereof, DNA, RNA, DNA/RNA hybrid, and related molecules, polynucleotides or oligonucleotides complementary to a 282P1G3 gene or mRNA sequence or a part thereof, and polynucleotides or oligonucleotides that hybridize to a 282P1G3 gene, mRNA, or to a 282P1G3 encoding polynucleotide (collectively, "282P1G3 polynucleotides"). In all instances when referred to in this section, T can also be U in FIG. 2.

Embodiments of a 282P1G3 polynucleotide include: a 282P1G3 polynucleotide having the sequence shown in FIG. 2, the nucleotide sequence of 282P1G3 as shown in FIG. 2 wherein T is U; at least 10 contiguous nucleotides of a polynucleotide having the sequence as shown in FIG. 2; or, at least 10 contiguous nucleotides of a polynucleotide having the sequence as shown in FIG. 2 where T is U. For example, embodiments of 282P1G3 nucleotides comprise, without limitation:

(I) a polynucleotide comprising, consisting essentially of, or consisting of a sequence as shown in FIG. 2, wherein T can also be U;

(II) a polynucleotide comprising, consisting essentially of, or consisting of the sequence as shown in FIG. 2A, from nucleotide residue number 272 through nucleotide residue number 3946, including the stop codon, wherein T can also be U;

(III) a polynucleotide comprising, consisting essentially of, or consisting of the sequence as shown in FIG. 2B, from nucleotide residue number 272 through nucleotide residue number 3787, including the stop codon, wherein T can also be U;

(IV) a polynucleotide comprising, consisting essentially of, or consisting of the sequence as shown in FIG. 2C, from nucleotide residue number 272 through nucleotide residue number 3953, including the a stop codon, wherein T can also be U;

(V) a polynucleotide comprising, consisting essentially of, or consisting of the sequence as shown in FIG. 2D, from nucleotide residue number 272 through nucleotide residue number 3625, including the stop codon, wherein T can also be U;

(VI) a polynucleotide comprising, consisting essentially of, or consisting of the sequence as shown in FIG. 2E, from nucleotide residue number 272 through nucleotide residue number 3898, including the stop codon, wherein T can also be U;

(VII) a polynucleotide comprising, consisting essentially of, or consisting of the sequence as shown in FIG. 2F, from nucleotide residue number 272 through nucleotide residue number 3823, including the stop codon, wherein T can also be U;

(VIII) a polynucleotide comprising, consisting essentially of, or consisting of the sequence as shown in FIG. 2G, from nucleotide residue number 272 through nucleotide residue number 3982, including the stop codon, wherein T can also be U;

(IX) a polynucleotide comprising, consisting essentially of, or consisting of the sequence as shown in FIG. 2H, from nucleotide residue number 272 through nucleotide residue number 3859, including the stop codon, wherein T can also be U;

(X) a polynucleotide comprising, consisting essentially of, or consisting of the sequence as shown in FIG. 2I, from nucleotide residue number 192 through nucleotide residue number 3866, including the stop codon, wherein T can also be U;

(XI) a polynucleotide that encodes a 282P1G3-related protein that is at least 90, 91, 92, 93, 94, 95, 96, 97, 98, 99 or 100% homologous to an entire amino acid sequence shown in FIGS. 2A–J;

(XII) a polynucleotide that encodes a 282P1G3-related protein that is at least 90, 91, 92, 93, 94, 95, 96, 97, 98, 99 or 100% identical to an entire amino acid sequence shown in FIGS. 2A–J;

(XIII) a polynucleotide that encodes at least one peptide set forth in Tables VIII–XXI and XXII–XLIX; (XIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A and 3I–3M in any whole number increment up to 1224 that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A and 3I–3M in any whole number increment up to 1224 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A and 3I–3M in any whole number increment up to 1224 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A and 3I–3M in any whole number increment up to 1224 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIGS. 3A and 3I–3M in any whole number increment up to 1224 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 1171 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 1171 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 1171 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 1171 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3B in any whole number increment up to 1171 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 893 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 893 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 893 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 893 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3C in any whole number increment up to 893 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XXIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 1117 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 1117 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXXI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 1117 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXXII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 1117 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXXIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3D in any whole number increment up to 1117 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XXXIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXXV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXXVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXXVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXXVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XXXIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3F in any whole number increment up to 1183 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XL) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3F in any whole number increment up to 1183 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XLI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3F in any whole number increment up to 1183 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XLII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3F in any whole number increment up to 1183 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XLIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3F in any whole number increment up to 1183 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XLIV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3G in any whole number increment up to 1236 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XLV) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3G in any whole number increment up to 1236 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XLVI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3G in any whole number increment up to 1236 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XLVII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3G in any whole number increment up to 1236 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XLVIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3G in any whole number increment up to 1236 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(XLIX) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3E in any whole number increment up to 1208 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(L) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3H in any whole number increment up to 1195 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(LI) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3H in any whole number increment up to 1195 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(LII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3H in any whole number increment up to 1195 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(LIII) a polynucleotide that encodes a peptide region of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a peptide of FIG. 3H in any whole number increment up to 1195 that includes 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9

(LIV) a polynucleotide that is fully complementary to a polynucleotide of any one of (I)–(LIII).

(LV) a peptide that is encoded by any of (I) to (LIV); and (LVI) a composition comprising a polynucleotide of any of (I)–(LIV) or peptide of (LV) together with a pharmaceutical excipient and/or in a human unit dose form.

(LVII) a method of using a polynucleotide of any (I)–(LIV) or peptide of (LV) or a composition of (LVI) in a method to modulate a cell expressing 282P1G3, (LVIII) a method of using a polynucleotide of any (I)–(LIV) or peptide of (LV) or a composition of (LVI) in a method to diagnose, prophylax, prognose, or treat an individual who bears a cell expressing 282P1G3

(LIX) a method of using a polynucleotide of any (I)–(LIV) or peptide of (LV) or a composition of (LVI) in a method to diagnose, prophylax, prognose, or treat an individual who bears a cell expressing 282P1G3, said cell from a cancer of a tissue listed in Table I;

(LX) a method of using a polynucleotide of any (I)–(LIV) or peptide of (LV) or a composition of (LVI) in a method to diagnose, prophylax, prognose, or treat a a cancer;

(LXI) a method of using a polynucleotide of any (I)–(LIV) or peptide of (LV) or a composition of (LVI) in a method to diagnose, prophylax, prognose, or treat a a cancer of a tissue listed in Table I; and, (LXII) a method of using a polynucleotide of any (I)–(LIV) or peptide of (LV) or a composition of (LVI) in a method to identify or characterize a modulator of a cell expressing 282P1G3.

As used herein, a range is understood to disclose specifically all whole unit positions thereof.

Typical embodiments of the invention disclosed herein include 282P1G3 polynucleotides that encode specific portions of 282P1G3 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1210, 1220, and 1224 or more contiguous amino acids of 282P1G3 variant 1; the maximal lengths relevant for other variants are: variant 2, 1171 amino acids; variant 3, 893 amino acids, variant 4, 1117 amino acids, variant 5, 1208 amino acids, variant 6, 1183 amoni acids, variant 7, 1236 amoni acids, variant 8, 1195 amino acids, variant 9, 1224 amino acids, variant 10, 1224 amino acids, variant 11, 1224 amino acids, variant 24, 1224 amino acids, and variant 25, 1224 amino acids.

For example, representative embodiments of the invention disclosed herein include: polynucleotides and their encoded peptides themselves encoding about amino acid 1 to about amino acid 10 of the 282P1G3 protein shown in FIG. 2 or FIG. 3, polynucleotides encoding about amino acid 10 to about amino acid 20 of the 282P1G3 protein shown in FIG. 2 or FIG. 3, polynucleotides encoding about amino acid 20 to about amino acid 30 of the 282P1G3 protein shown in FIG. 2 or FIG. 3, polynucleotides encoding about amino acid 30 to about amino acid 40 of the 282P1G3 protein shown in FIG. 2 or FIG. 3, polynucleotides encoding about amino acid 40 to about amino acid 50 of the 282P1G3 protein shown in FIG. 2 or FIG. 3, polynucleotides encoding about amino acid 50 to about amino acid 60 of the 282P1G3 protein shown in FIG. 2 or FIG. 3, polynucleotides encoding about amino acid 60 to about amino acid 70 of the 282P1G3 protein shown in FIG. 2 or FIG. 3, polynucleotides encoding about amino acid 70 to about amino acid 80 of the 282P1G3 protein shown in FIG. 2 or FIG. 3, polynucleotides encoding about amino acid 80 to about amino acid 90 of the 282P1G3 protein shown in FIG. 2 or FIG. 3, polynucleotides encoding about amino acid 90 to about amino acid 100 of the 282P1G3 protein shown in FIG. 2 or FIG. 3, in increments of about 10 amino acids, ending at the carboxyl terminal amino acid set forth in FIG. 2 or FIG. 3. Accordingly, polynucleotides encoding portions of the amino acid sequence (of about 10 amino acids), of amino acids, 100 through the carboxyl terminal amino acid of the 282P1G3 protein are embodiments of the invention. Wherein it is understood that each particular amino acid position discloses that position plus or minus five amino acid residues.

Polynucleotides encoding relatively long portions of a 282P1G3 protein are also within the scope of the invention. For example, polynucleotides encoding from about amino acid 1 (or 20 or 30 or 40 etc.) to about amino acid 20, (or 30, or 40 or 50 etc.) of the 282P1G3 protein "or variant" shown in FIG. 2 or FIG. 3 can be generated by a variety of techniques well known in the art. These polynucleotide fragments can include any portion of the 282P1G3 sequence as shown in FIG. 2.

Additional illustrative embodiments of the invention disclosed herein include 282P1G3 polynucleotide fragments encoding one or more of the biological motifs contained within a 282P1G3 protein "or variant" sequence, including one or more of the motif-bearing subsequences of a 282P1G3 protein "or variant" set forth in Tables VIII–XXI and XXII–XLIX. In another embodiment, typical polynucleotide fragments of the invention encode one or more of the regions of 282P1G3 protein or variant that exhibit homology to a known molecule. In another embodiment of the invention, typical polynucleotide fragments can encode one or more of the 282P1G3 protein or variant N-glycosylation sites, cAMP and cGMP-dependent protein kinase phosphorylation sites, casein kinase II phosphorylation sites or N-myristoylation site and amidation sites.

Note that to determine the starting position of any peptide set forth in Tables VIII–XXI and Tables XXII to XLIX (collectively HLA Peptide Tables) respective to its parental protein, e.g., variant 1, variant 2, etc., reference is made to three factors: the particular variant, the length of the peptide in an HLA Peptide Table, and the Search Peptides listed in Table VII. Generally, a unique Search Peptide is used to obtain HLA peptides for a particular variant. The position of each Search Peptide relative to its respective parent molecule is listed in Table VII. Accordingly, if a Search Peptide begins at position "X", one must add the value "X minus 1" to each position in Tables VIII–XXI and Tables XXII–IL to obtain the actual position of the HLA peptides in their parental molecule. For example if a particular Search Peptide begins at position 150 of its parental molecule, one must add 150−1, i.e., 149 to each HLA peptide amino acid position to calculate the position of that amino acid in the parent molecule.

II.A.) Uses of 282P1G3 Polynucleotides

II.A.1.) Monitoring of Genetic Abnormalities

The polynucleotides of the preceding paragraphs have a number of different specific uses. The human 282P1G3 gene maps to the chromosomal location set forth in the Example entitled "Chromosomal Mapping of 282P1G3." For example, because the 282P1G3 gene maps to this chromosome, polynucleotides that encode different regions of the 282P1G3 proteins are used to characterize cytogenetic abnormalities of this chromosomal locale, such as abnormalities that are identified as being associated with various cancers. In certain genes, a variety of chromosomal abnormalities including rearrangements have been identified as frequent cytogenetic abnormalities in a number of different cancers (see e.g. Krajinovic et al., Mutat. Res. 382(3–4): 81–83 (1998); Johansson et al., Blood 86(10): 3905–3914 (1995) and Finger et al., P.N.A.S. 85(23): 9158–9162 (1988)). Thus, polynucleotides encoding specific regions of the 282P1G3 proteins provide new tools that can be used to delineate, with greater precision than previously possible, cytogenetic abnormalities in the chromosomal region that encodes 282P1G3 that may contribute to the malignant phenotype. In this context, these polynucleotides satisfy a need in the art for expanding the sensitivity of chromosomal screening in order to identify more subtle and less common chromosomal abnormalities (see e.g. Evans et al., Am. J. Obstet. Gynecol 171(4): 1055–1057 (1994)).

Furthermore, as 282P1G3 was shown to be highly expressed in prostate and other cancers, 282P1G3 polynucleotides are used in methods assessing the status of 282P1G3 gene products in normal versus cancerous tissues. Typically, polynucleotides that encode specific regions of the 282P1G3 proteins are used to assess the presence of perturbations (such as deletions, insertions, point mutations, or alterations resulting in a loss of an antigen etc.) in specific regions of the 282P1G3 gene, such as regions containing one or more motifs. Exemplary assays include both RT-PCR assays as well as single-strand conformation polymorphism (SSCP) analysis (see, e.g., Marrogi et al., J. Cutan. Pathol. 26(8): 369–378 (1999), both of which utilize polynucleotides encoding specific regions of a protein to examine these regions within the protein.

II.A.2.) Antisense Embodiments

Other specifically contemplated nucleic acid related embodiments of the invention disclosed herein are genomic DNA, cDNAs, ribozymes, and anbisense molecules, as well as nucleic acid molecules based on an alterative backbone, or including alternative bases, whether derived from natural sources or synthesized, and include molecules capable of inhibiting the RNA or protein expression of 282P1G3. For example, antisense molecules can be RNAs or other molecules, including peptide nucleic acids (PNAs) or non-nucleic acid molecules such as phosphorothioate derivatives that specifically bind DNA or RNA in a base pair-dependent manner. A skilled artisan can readily obtain these classes of nucleic acid molecules using the 282P1G3 polynucleotides and polynucleotide sequences disclosed herein.

Antisense technology entails the administration of exogenous oligonucleotides that bind to a target polynucleotide located within the cells. The term "antisense" refers to the fact that such oligonucleotides are complementary to their intracellular targets, e.g., 282P1G3. See for example, Jack Cohen, Oligodeoxynucleotides, Antisense Inhibitors of Gene Expression, CRC Press, 1989; and Synthesis 1:1–5 (1988). The 282P1G3 antisense oligonucleotides of the present invention include derivatives such as S-oligonucleotides (phosphorothioate derivatives or S-oligos, see, Jack Cohen, supra), which exhibit enhanced cancer cell growth inhibitory action. S-oligos (nucleoside phosphorothioates) are isoelectronic analogs of an oligonucleotide (O-oligo) in which a nonbridging oxygen atom of the phosphate group is replaced by a sulfur atom. The S-oligos of the present invention can be prepared by treatment of the corresponding O-oligos with 3H-1,2-benzodithiol-3-one-1,1-dioxide, which is a sulfur transfer reagent. See, e.g., lyer, R. P. et al., J. Org. Chem. 55:4693–4698 (1990); and lyer, R. P. et al., J. Am. Chem. Soc. 112:1253–1254 (1990). Additional 282P1G3 antisense oligonucleotides of the present invention include morpholino antisense oligonucleotides known in the art (see, e.g., Partridge et al., 1996, Antisense & Nucleic Acid Drug Development 6:169–175).

The 282P1G3 antisense oligonucleotides of the present invention typically can be RNA or DNA that is complementary to and stably hybridizes with the first 100 5' codons or last 100 3' codons of a 282P1G3 gencmic sequence or the corresponding mRNA. Absolute complementarity is not required, although high degrees of complementarity are preferred. Use of an oligonucleotide complementary to this region allows for the selective hybridization to 282P1G3 mRNA and not to mRNA specifying other regulatory subunits of protein kinase. In one embodiment, 282P1G3 antisense oligonucleotides of the present invention are 15 to 30-mer fragments of the antisense DNA molecule that have a sequence that hybridizes to 282P1G3 mRNA. Optionally, 282P1G3 antisense oligonucleotide is a 30-mer oligonucleotide that is complementary to a region in the first 105' codons or last 10 3' codons of 282P1G3. Alternatively, the antisense molecules are modified to employ ribozymes in the inhibition of 282P1G3 expression, see, e.g., L. A. Couture & D. T. Stinchcomb; *Trends Genet* 12: 510–515 (1996).

II.A.3.) Primers and Primer Pairs

Further specific embodiments of these nucleotides of the invention include primers and primer pairs, which allow the specific amplification of polynucleotides of the invention or of any specific parts thereof, and probes that selectively or specifically hybridize to nucleic acid molecules of the invention or to any part thereof. Probes can be labeled with a detectable marker, such as, for example, a radioisotope, fluorescent compound, bioluminescent compound, a chemiluminescent compound, metal chelator or enzyme. Such probes and primers are used to detect the presence of a 282P1G3 polynucleotide in a sample and as a means for detecting a cell expressing a 282P1G3 protein.

Examples of such probes include polypeptides comprising all or part of the human 282P1G3 cDNA sequence shown in FIG. 2. Examples of primer pairs capable of specifically amplifying 282P1G3 mRNAs are also described in the Examples. As will be understood by the skilled artisan, a great many different primers and probes can be prepared based on the sequences provided herein and used effectively to amplify and/or detect a 282P1G3 mRNA.

The 282P1G3 polynucleotides of the invention are useful for a variety of purposes, including but not limited to their use as probes and primers for the amplification and/or detection of the 282P1G3 gene(s), mRNA(s), or fragments thereof; as reagents for the diagnosis and/or prognosis of prostate cancer and other cancers; as coding sequences capable of directing the expression of 282P1G3 polypeptides; as tools for modulating or inhibiting the expression of the 282P1G3 gene(s) and/or translation of the 282P1G3 transcript(s); and as therapeutic agents.

The present invention includes the use of any probe as described herein to identify and isolate a 282P1G3 or 282P1G3 related nucleic acid sequence from a naturally occurring source, such as humans or other mammals, as well as the isolated nucleic acid sequence per se, which would comprise all or most of the sequences found in the probe used.

II.A.4.) Isolation of 282P1G3-Encoding Nucleic Acid Molecules

The 282P1G3 cDNA sequences described herein enable the isolation of other polynucleotides encoding 282P1G3 gene product(s), as well as the isolation of polynucleotides encoding 282P1G3 gene product homologs, altematively spliced isoforms, allelic variants, and mutant forms of a 282P1G3 gene product as well as polynucleotides that encode analogs of 282P1G3-related proteins. Various molecular cloning methods that can be employed to isolate full length cDNAs encoding a 282P1G3 gene are well known (see, for example, Sambrook, J. et al., Molecular Cloning: A Laboratory Manual, 2d edition, Cold Spring Harbor Press, New York, 1989; Current Protocols in Molecular Biology. Ausubel et al., Eds., Wiley and Sons, 1995). For example, lambda phage cloning methodologies can be conveniently employed, using commerdally available cloning systems (e.g., Lambda ZAP Express, Stratagene). Phage clones containing 282P1G3 gene cDNAs can be identified by probing with a labeled 282P1G3 cDNA or a fragment thereof. For example, in one embodiment, a 282P1G3 cDNA (e.g., FIG. 2) or a portion thereof can be synthesized and used as a probe to retrieve overlapping and full-length cDNAs corresponding to a 282P1G3 gene. A 282P1G3 gene itself can be isolated by screening genomic DNA libraries, bacterial artificial chromosome libraries (BACs), yeast artificial chromosome libraries (YACs), and the like, with 282P1G3 DNA probes or primers.

II.A.5.) Recombinant Nucleic Acid Molecules and Host-Vector Systems

The invention also provides recombinant DNA or RNA molecules containing a 282P1G3 polynucleotide, a fragment, analog or homologue thereof, including but not limited to phages, plasmids, phagemids, cosmids, YACs, BACs, as well as various viral and non-viral vectors well known in the art, and cells transformed or transfected with such recombinant DNA or RNA molecules. Methods for generating such molecules are well known (see, for example, Sambrook et al., 1989, supra).

The invention further provides a host-vector system comprising a recombinant DNA molecule containing a 282P1G3 polynucleotide, fragment, analog or homologue thereof within a suitable prokaryotic or eukaryotic host cell. Examples of suitable eukaryotic host cells include a yeast cell, a plant cell, or an animal cell, such as a mammalian cell or an insect cell (e.g., a baculovirus-infectible cell such as an Sf9 or HighFive cell). Examples of suitable mammalian cells include various prostate cancer cell lines such as DU145 and TsuPr1, other transfectable or transducible prostate cancer cell lines, primary cells (PrEC), as well as a number of mammalian cells routinely used for the expression of recombinant proteins (e.g., COS, CHO, 293, 293T cells). More particularly, a polynucleotide comprising the coding sequence of 282P1G3 or a fragment, analog or homolog thereof can be used to generate 282P1G3 proteins or fragments thereof using any number of host-vector systems routinely used and widely known in the art.

A wide range of host-vector systems suitable for the expression of 282P1G3 proteins or fragments thereof are available, see for example, Sambrook et al., 1989, supra; Current Protocols in Molecular Biology, 1995, supra). Preferred vectors for mammalian expression include but are not limited to pcDNA 3.1 myc-His-tag (Invitrogen) and the retroviral vector pSRαtkneo (Muller et al., 1991, MCB 11:1785). Using these expression vectors, 282P1G3 can be expressed in several prostate cancer and non-prostate cell lines, including for example 293, 293T, rat-1, NIH 3T3 and TsuPr1. The host-vector systems of the invention are useful for the production of a 282P1G3 protein or fragment thereof. Such host-vector systems can be employed to study the functional properties of 282P1G3 and 282P1G3 mutations or analogs.

Recombinant human 282P1G3 protein or an analog or homolog or fragment thereof can be produced by mammalian cells transfected with a construct encoding a 282P1G3-related nucleotide. For example, 293T cells can be transfected with an expression plasmid encoding 282P1G3 or fragment, analog or homolog thereof, a 282P1G3-related protein is expressed in the 293T cells, and the recombinant 282P1G3 protein is isolated using standard purification methods (e.g., affinity purification using anti-282P1G3 antibodies). In another embodiment, a 282P1G3 coding sequence is subcloned into the retroviral vector pSRαMSVtkneo and used to infect various mammalian cell lines, such as NIH 3T3, TsuPr1, 293 and rat-1 in order to establish 282P1G3 expressing cell lines. Various other expression systems well known in the art can also be employed. Expression constructs encoding a leader peptide joined in frame to a 282P1G3 coding sequence can be used for the generation of a secreted form of recombinant 282P1G3 protein.

As discussed herein, redundancy in the genetic code permits variation in 282P1G3 gene sequences. In particular, it is known in the art that specific host species often have specific codon preferences, and thus one can adapt the disclosed sequence as preferred for a desired host. For example, preferred analog codon sequences typically have rare codons (i.e., codons having a usage frequency of less than about 20% in known sequences of the desired host) replaced with higher frequency codons. Codon preferences for a specific species are calculated, for example, by utilizing codon usage tables available on the INTERNET.

Additional sequence modifications are known to enhance protein expression in a cellular host. These include elimination of sequences encoding spurious polyadenylation signals, exon/intron splice site signals, transposon-like repeats, and/or other such well-characterized sequences that are deleterious to gene expression. The GC content of the sequence is adjusted to levels average for a given cellular host, as calculated by reference to known genes expressed in the host cell. Where possible, the sequence is modified to avoid predicted hairpin secondary mRNA structures. Other useful modifications include the addition of a translational initiation consensus sequence at the start of the open reading frame, as described in Kozak, *Mol. Cell Biol.*, 9:5073–5080 (1989). Skilled artisans understand that the general rule that eukaryotic ribosomes initiate translation exclusively at the 5' proximal AUG codon is abrogated only under rare conditions (see, e.g., Kozak PNAS 92(7): 2662–2666, (1995) and Kozak NAR 15(20): 8125–8148 (1987)).

III.) 282P1G3-related Proteins

Another aspect of the present invention provides 282P1G3-related proteins. Specific embodiments of 282P1G3 proteins comprise a polypeptide having all or part of the amino acid sequence of human 282P1G3 as shown in FIG. 2 or FIG. 3. Alternatively, embodiments of 282P1G3 proteins comprise variant, homolog or analog polypeptides that have alterations in the amino acid sequence of 282P1G3 shown in FIG. 2 or FIG. 3.

Embodiments of a 282P1G3 polypeptide include: a 282P1G3 polypeptide having a sequence shown in FIG. 2, a peptide sequence of a 282P1G3 as shown in FIG. 2 wherein T is U; at least 10 contiguous nucleotides of a polypeptide having the sequence as shown in FIG. 2; or, at least 10 contiguous peptides of a polypeptide having the sequence as shown in FIG. 2 where T is U. For example, embodiments of 282P1G3 peptides comprise, without limitation:

(I) a protein comprising, consisting essentially of, or consisting of an amino acid sequence as shown in FIGS. 2A–J or FIGS. 3A–M;

(II) a 282P1G3-related protein that is at least 90, 91, 92, 93, 94, 95, 96, 97, 98, 99 or 100% homologous to an entire amino acid sequence shown in FIGS. 2A–J or 3A–M;

(III) a 282P1G3-related protein that is at least 90, 91, 92, 93, 94, 95, 96, 97, 98, 99 or 100% identical to an entire amino acid sequence shown in FIGS. 2A–J or 3A–M;

(IV) a protein that comprises at least one peptide set forth in Tables VIII to XLIX, optionally with a proviso that it is not an entire protein of FIG. 2;

(V) a protein that comprises at least one peptide set forth in Tables VIII–XXI, collectively, which peptide is also set forth in Tables XXII to XLIX, collectively, optionally with a proviso that it is not an entire protein of FIG. 2;

(VI) a protein that comprises at least two peptides selected from the peptides set forth in Tables VIII–XLIX, optionally with a proviso that it is not an entire protein of FIG. 2;

(VII) a protein that comprises at least two peptides selected from the peptides set forth in Tables VIII to XLIX collectively, with a proviso that the protein is not a contiguous sequence from an amino acid sequence of FIG. 2;

(VIII) a protein that comprises at least one peptide selected from the peptides set forth in Tables VIII–XXI; and at least one peptide selected from the peptides set forth in Tables XXII to XLIX, with a proviso that the protein is not a contiguous sequence from an amino acid sequence of FIG. 2;

(IX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3I–3M in any whole number increment up to 1224 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(X) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3I–3M, in any whole number increment up to 1224 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3I–3M, in any whole number increment up to 1224 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIGS. 3A, 3I–3M, in any whole number increment up to 1224 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIGS. 3A, 3I–3M in any whole number increment up to 1224 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 1171 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 1171 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 1171 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3B, in any whole number increment up to 1171 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3B in any whole number increment up to 1171 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XIX) a polypeptide comprising at least 5, 6, 7, 8, 9, 10, 11, 12, 13, 14, 15, 16,17, 18, 19, 20, 21, 22, 23, 24, 25, 26, 27, 28, 29, 30, 31, 32, 33, 34, 35 amino acids of a protein of FIG. 3C, in any whole number increment up to 893 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, in any whole number increment up to 893 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, in any whole number increment up to 893 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3C, in any whole number increment up to 893 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3C in any whole number increment up to 893 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 1117 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 1117 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 1117 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3D, in any whole number increment up to 1117 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3D in any whole number increment up to 1117 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXIX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3E, in any whole number increment up to 1208 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3E, in any whole number increment up to 1208 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXXI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3E, in any whole number increment up to 1208 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXXII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3E, in any whole number increment up to 1208 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXXIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3E in any whole number increment up to 1208 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXXIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3F, in any whole number increment up to 1183 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XXXV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3F, in any whole number increment up to 1183 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XXXVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3F, in any whole number increment up to 1183 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XXXVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3F, in any whole number increment up to 1183 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XXXVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3F in any whole number increment up to 1183 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XXXIX) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3G, in any whole number increment up to 1236 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XL) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3G, in any whole number increment up to 1236 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XLI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3G, in any whole number increment up to 1236 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XLII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3G, in any whole number increment up to 1236 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XLIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3G in any whole number increment up to 1236 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XLIV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3H, in any whole number increment up to 1195 respectively that includes at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Hydrophilicity profile of FIG. 5;

(XLV) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3H, in any whole number increment up to 1195 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value less than 0.5 in the Hydropathicity profile of FIG. 6;

(XLVI) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3H, in any whole number increment up to 1195 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Percent Accessible Residues profile of FIG. 7;

(XLVII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acids of a protein of FIG. 3H, in any whole number increment up to 1195 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Average Flexibility profile of FIG. 8;

(XLVIII) a polypeptide comprising at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, amino acids of a protein of FIG. 3H in any whole number increment up to 1195 respectively that includes at least at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 amino acid position(s) having a value greater than 0.5 in the Beta-turn profile of FIG. 9;

(XLIX) a peptide that occurs at least twice in Tables VIII–XXI and XXII to XLIX, collectively;

(L) a peptide that occurs at least three times in Tables VIII–XXI and XXII to XLIX, collectively;

(LI) a peptide that occurs at least four times in Tables VIII–XXI and XXII to XLIX, collectively;

(LII) a peptide that occurs at least five times in Tables VIII–XXI and XXII to XLIX, collectively;

(LIII) a peptide that occurs at least once in Tables VIII–XXI, and at least once in tables XXII to XLIX;

(LIV) a peptide that occurs at least once in Tables VIII–XXI, and at least twice in tables XXII to XLIX;

(LV) a peptide that occurs at least twice in Tables VIII–XXI, and at least once in tables XXII to XLIX;

(LVI) a peptide that occurs at least twice in Tables VIII–XXI, and at least twice in tables XXII to XLIX;

(LVII) a peptide which comprises one two, three, four, or five of the following characteristics, or an oligonucleotide encoding such peptide:

i) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Hydrophilicity profile of FIG. 5;

ii) a region of at least 5 amino acids of a particular peptide of FIG. 3, in any whole number increment up to the full length of that protein in FIG. 3, that includes an amino acid position having a value equal to or less than 0.5, 0.4, 0.3, 0.2, 0.1, or having a value equal to 0.0, in the Hydropathicity profile of FIG. 6;

iii) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Percent Accessible Residues profile of FIG. 7;

iv) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Average Flexibility profile of FIG. 8; or, v) a region of at least 5 amino acids of a particular peptide of FIG. 3, in any whole number increment up to the full length of that protein in FIG. 3, that includes an amino acid position having a value equal to or greater than 0.5, 0.6, 0.7, 0.8, 0.9, or having a value equal to 1.0, in the Beta-turn profile of FIG. 9;

(LVIII) a composition comprising a peptide of (I)–(LVII) or an antibody or binding region thereof together with a pharmaceutical excipient and/or in a human unit dose form.

(LIX) a method of using a peptide of (I)–(LVII), or an antibody or binding region thereof or a composition of (LVIII) in a method to modulate a cell expressing 282P1G3, (LX) a method of using a peptide of (I)–(LVII) or an antibody or binding region thereof or a composition of (LVIII) in a method to diagnose, prophylax, prognose, or treat an individual who bears a cell expressing 282P1G3

(LXI) a method of using a peptide of (I)–(LVII) or an antibody or binding region thereof or a composition (LVIII) in a method to diagnose, prophylax, prognose, or treat an individual who bears a cell expressing 282P1G3, said cell from a cancer of a tissue listed in Table I;

(LXII) a method of using a peptide of (I)–(LVII) or an antibody or binding region thereof or a composition of (LVIII) in a method to diagnose, prophylax, prognose, or treat a a cancer;

(LXIII) a method of using a peptide of (I)–(LVII) or an antibody or binding region thereof or a composition of (LVIII) in a method to diagnose, prophylax, prognose, or treat a a cancer of a tissue listed in Table I; and, (LXIV) a method of using a a peptide of (I)–(LVII) or an antibody or binding region thereof or a composition (LVIII) in a method to identify or characterize a modulator of a cell expressing 282P1G3.

As used herein, a range is understood to specifically disclose all whole unit positions thereof.

Typical embodiments of the invention disclosed herein include 282P1G3 polynucleotides that encode specific portions of 282P1G3 mRNA sequences (and those which are complementary to such sequences) such as those that encode the proteins and/or fragments thereof, for example:

(a) 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1210, 1215, 1220, and 1224 or more contiguous amino acids of282P1G3 variant 1; the maximal lengths relevant for other variants are: variant 2, 1171 amino acids; variant 3, 893 amino acids, variant 4, 1117 amino acids, variant 5, 1208 amino acids, variant 6, 1183 amino acids, variant 7, 1236 amino acids, variant 8, 1195 amino acids, variant 9, 1224 amino acids, variant 10, 1224 amino acids, variant 11, 1224 amino acids, variant 24, 1224 amino acids, and variant 25, 1224 amino acids.

In general, naturally occurring allelic variants of human 282P1G3 share a high degree of structural identity and homology (e.g., 90% or more homology). Typically, allelic variants of a 282P1G3 protein contain conservative amino acid substitutions within the 282P1G3 sequences described herein or contain a substitution of an amino acid from a corresponding position in a homologue of 282P1G3. One class of 282P1G3 allelic variants are proteins that share a high degree of homology with at least a small region of a particular 282P1G3 amino acid sequence, but further contain a radical departure from the sequence, such as a non-conservative substitution, truncation, insertion or frame shift. In comparisons of protein sequences, the terms, similarity, identity, and homology each have a distinct meaning as appreciated in the field of genetics. Moreover, orthology and paralogy can be important concepts describing the relationship of members of a given protein family in one organism to the members of the same family in other organisms.

Amino acid abbreviations are provided in Table II. Conservative amino acid substitutions can frequently be made in a protein without altering either the conformation or the function of the protein. Proteins of the invention can comprise 1, 2, 3, 4, 5, 6, 7, 8, 9, 10, 11, 12, 13, 14, 15 conservative substitutions. Such changes include substituting any of isoleucine (I), valine (V), and leucine (L) for any other of these hydrophobic amino acids; aspartic acid (D) for glutamic acid (E) and vice versa; glutamine (Q) for asparagine (N) and vice versa; and serine (S) for threonine (T) and vice versa. Other substitutions can also be considered conservative, depending on the environment of the particular amino acid and its role in the three-dimensional structure of the protein. For example, glycine (G) and alanine (A) can frequently be interchangeable, as can alanine (A) and valine (V). Methionine (M), which is relatively hydrophobic, can frequently be interchanged with leucine and isoleucine, and sometimes with valine. Lysine (K) and arginine (R) are frequently interchangeable in locations in which the significant feature of the amino acid residue is its charge and the differing pK's of these two amino acid residues are not significant. Still other changes can be considered "conservative" in particular environments (see, e.g. Table IIII herein; pages 13–15 "Biochemistry" $2^{nd}$ ED. Lubert Stryered (Stanford University); Henikoff et al., PNAS 1992 Vol 89 10915–10919; Lei et al., J Biol Chem May 19, 1995; 270(20):11882–6).

Embodiments of the invention disclosed herein include a wide variety of art-accepted variants or analogs of 282P1G3 proteins such as polypeptides having amino acid insertions, deletions and substitutions. 282P1G3 variants can be made using methods known in the art such as site-directed mutagenesis, alanine scanning, and PCR mutagenesis. Site-directed mutagenesis (Carter et al., *Nucl. Acids Res.*, 13:4331 (1986); Zoller et al., *Nucl. Acids Res.*, 10:6487 (1987)), cassette mutagenesis (Wells et al., Gene, 34:315 (1985)), restriction selection mutagenesis (Wells et al., *Philos. Trans. R. Soc. London SerA*, 317:415 (1986)) or other known techniques can be performed on the cloned DNA to produce the 282P1G3 variant DNA.

Scanning amino acid analysis can also be employed to identify one or more amino acids along a contiguous sequence that is involved in a specific biological activity such as a protein-protein interaction. Among the preferred scanning amino acids are relatively small, neutral amino acids. Such amino acids include alanine, glycine, serine, and cysteine. Alanine is typically a preferred scanning amino acid among this group because it eliminates the side-chain beyond the beta-carbon and is less likely to alter the main-chain conformation of the variant. Alanine is also typically preferred because it is the most common amino acid. Further, it is frequently found in both buried and exposed positions (Creighton, *The Proteins*, (W. H. Freeman & Co., N.Y.); Chothia, J. Mol. Biol., 150:1 (1976)). If alanine substitution does not yield adequate amounts of variant, an isosteric amino acid can be used.

As defined herein, 282P1G3 variants, analogs or homologs, have the distinguishing attribute of having at least one epitope that is "cross reactive" with a 282P1G3 protein having an amino acid sequence of FIG. 3. As used in this sentence, "cross reactive" means that an antibody or T cell that specifically binds to a 282P1G3 variant also specifically binds to a 282P1G3 protein having an amino acid sequence set forth in FIG. 3. A polypeptide ceases to be a variant of a protein shown in FIG. 3, when it no longer contains any epitope capable of being recognized by an antibody or T cell that specifically binds to the starting 282P1G3 protein. Those skilled in the art understand that antibodies that recognize proteins bind to epitopes of varying size, and a grouping of the order of about four or five amino acids, contiguous or not, is regarded as a typical number of amino acids in a minimal epitope. See, e.g., Nair et al., J. Immunol 2000 165(12): 6949–6955; Hebbes et al., Mol Immunol (1989) 26(9):865–73; Schwartz et al., J Immunol (1985) 135(4):2598–608.

Other classes of 282P1G3-related protein variants share 70%, 75%, 80%, 85% or 90% or more similarity with an amino acid sequence of FIG. 3, or a fragment thereof. Another specific class of 282P1G3 protein variants or analogs comprises one or more of the 282P1G3 biological motifs described herein or presently known in the art. Thus, encompassed by the present invention are analogs of 282P1G3 fragments (nucleic or amino acid) that have altered functional (e.g. immunogenic) properties relative to the starting fragment. It is to be appreciated that motifs now or which become part of the art are to be applied to the nucleic or amino acid sequences of FIG. 2 or FIG. 3.

As discussed herein, embodiments of the claimed invention include polypeptides containing less than the full amino acid sequence of a 282P1G3 protein shown in FIG. 2 or FIG. 3. For example, representative embodiments of the invention comprise peptides/proteins having any 4, 5, 6, 7, 8, 9, 10, 11, 12, 13, 14, 15 or more contiguous amino acids of a 282P1G3 protein shown in FIG. 2 or FIG. 3.

Moreover, representative embodiments of the invention disclosed herein include polypeptides consisting of about amino acid 1 to about amino acid 10 of a 282P1G3 protein shown in FIG. 2 or FIG. 3, polypeptides consisting of about amino acid 10 to about amino acid 20 of a 282P1G3 protein shown in FIG. 2 or FIG. 3, polypeptides consisting of about amino acid 20 to about amino acid 30 of a 282P1G3 protein shown in FIG. 2 or FIG. 3, polypeptides consisting of about amino acid 30 to about amino acid 40 of a 282P1G3 protein shown in FIG. 2 or FIG. 3, polypeptides consisting of about amino acid 40 to about amino acid 50 of a 282P1G3 protein shown in FIG. 2 or FIG. 3, polypeptides consisting of about amino acid 50 to about amino acid 60 of a 282P1G3 protein shown in FIG. 2 or FIG. 3, polypeptides consisting of about amino acid 60 to about amino acid 70 of a 282P1G3 protein shown in FIG. 2 or FIG. 3, polypeptides consist of about amino acid 70 to about amino acid 80 of a 282P1G3 protein shown in FIG. 2 or FIG. 3, polypeptides consisting of about amino acid 80 to about amino acid 90 of a 282P1G3 protein shown in FIG. 2 or FIG. 3, polypeptides consisting of about amino acid 90 to about amino acid 100 of a 282P1G3 protein shown in FIG. 2 or FIG. 3, etc. throughout the entirety of a 282P1G3 amino acid sequence. Moreover, polypeptides consisting of about amino acid 1 (or 20 or 30 or 40 etc.) to about amino acid 20, (or 130, or 140 or 150 etc.) of a 282P1G3 protein shown in FIG. 2 or FIG. 3 are embodiments of the invention. It is to be appreciated that the starting and stopping positions in this paragraph refer to the specified position as well as that position plus or minus 5 residues.

282P1G3-related proteins are generated using standard peptide synthesis technology or using chemical cleavage methods well known in the art. Alternatively, recombinant methods can be used to generate nucleic acid molecules that encode a 282P1G3-related protein. In one embodiment, nucleic acid molecules provide a means to generate defined fragments of a 282P1G3 protein (or variants, homologs or analogs thereof).

III.A.) Motif-bearing Protein Embodiments

Additional illustrative embodiments of the invention disclosed herein include 282P1G3 polypeptides comprising the amino acid residues of one or more of the biological motifs contained within a 282P1G3 polypeptide sequence set forth in FIG. 2 or FIG. 3. Various motifs are known in the art, and a protein can be evaluated for the presence of such motifs by a number of publicly available Internet sites (see, e.g., Epimatrix™ and Epimer™, Brown University, and BIMAS.

Motif bearing subsequences of all 282P1G3 variant proteins are set forth and identified in Tables VIII–XXI and XXII–XLIX.

Table V sets forth several frequently occurring motifs based on pfam searches. The columns of Table V list (1) motif name abbreviation, (2) percent identity found amongst the different member of the motif family, (3) motif name or description and (4) most common function; location information is included if the motif is relevant for location.

Polypeptides comprising one or more of the 282P1G3 motifs discussed above are useful in elucidating the specific characteristics of a malignant phenotype in view of the observation that the 282P1G3 motifs discussed above are associated with growth dysregulation and because 282P1G3 is overexpressed in certain cancers (See, e.g., Table I). Casein kinase II, cAMP and camp-dependent protein kinase, and Protein Kinase C, for example, are enzymes known to be associated with the development of the malignant phenotype (see e.g. Chen et al., Lab Invest., 78(2): 165–174 (1998); Gaiddon et al., Endocrinology 136(10): 4331–4338 (1995); Hall et al., Nucleic Acids Research 24(6): 1119–1126 (1996); Peterziel et al., Oncogene 18(46): 6322–6329 (1999) and O'Brian, Oncol. Rep. 5(2): 305–309 (1998)). Moreover, both glycosylation and myristoylation are protein modifications also associated with cancer and cancer progression (see e.g. Dennis et al., Biochem. Biophys. Acta 1473(1):21–34 (1999); Raju et al., Exp. Cell Res. 235(1): 145–154 (1997)). Amidation is another protein modification also associated with cancer and cancer progression (see e.g. Treston et al., J. Natl. Cancer Inst. Monogr. (13): 169–175 (1992)).

In another embodiment, proteins of the invention comprise one or more of the immunoreactive epitopes identified in accordance with art-accepted methods, such as the peptides set forth in Tables VIII–XXI and XXII–XLIX. CTL epitopes can be determined using specific algorithms to identify peptides within a 282P1G3 protein that are capable of optimally binding to specified HLA alleles (e.g., Table IV; Epimatrix™ and Epimer™, Brown University, and BIMAS. Moreover, processes for identifying peptides that have sufficient binding affinity for HLA molecules and which are correlated with being immunogenic epitopes, are well known in the art, and are carried out without undue experimentation. In addition, processes for identifying peptides that are immunogenic epitopes, are well known in the art, and are carried out without undue experimentation either in vitro or in vivo.

Also known in the art are principles for creating analogs of such epitopes in order to modulate immunogenicity. For example, one begins with an epitope that bears a CTL or HTL motif (see, e.g., the HLA Class I and HLA Class II motifs/supermotifs of Table IV). The epitope is analoged by substituting out an amino acid at one of the specified positions, and replacing it with another amino acid specified for that position. For example, on the basis of residues defined in Table IV, one can substitute out a deleterious residue in favor of any other residue, such as a preferred residue; substitute a less-preferred residue with a preferred residue; or substitute an originally-occurring preferred residue with another preferred residue. Substitutions can occur at primary anchor positions or at other positions in a peptide; see, e.g., Table IV.

A variety of references reflect the art regarding the identification and generation of epitopes in a protein of interest as well as analogs thereof. See, for example, WO 97/33602 to Chesnut et al.; Sette, Immunogenetics 1999 50(3–4): 201–212; Selle et al., J. Immunol. 2001 166(2): 1389–1397; Sidney et al., Hum. Immunol. 1997 58(1): 12–20; Kondo et al., Immunogenetics 1997 45(4): 249–258; Sidney et al., J. Immunol. 1996 157(8): 3480–90; and Falk et al., Nature 351: 290–6 (1991); Hunt et al., Science 255:1261–3 (1992); Parker et al., J. Immunol. 149:3580–7 (1992); Parker et al., J. Immunol. 152:163–75(1994)); Kast et al., 1994 152(8): 3904–12; Borras-Cuesta et al., Hum. Immunol. 2000 61(3): 266–278; Alexander et al., J. Immunol. 2000 164(3); 164(3): 1625–1633; Alexander et al., PMID: 7895164, UI: 95202582; O'Sullivan et al., J. Immunol. 1991 147(8): 2663–2669; Alexander et al., Immunity 1994 1(9): 751–761 and Alexander et al., Immunol. Res. 1998 18(2): 79–92.

Related embodiments of the invention include polypeptides comprising combinations of the different motifs set forth in Table VI, and/or, one or more of the predicted CTL epitopes of Tables VIII–XXI and XXII–XLIX, and/or, one or more of the predicted HTL epitopes of Tables XLVI–XLIX, and/or, one or more of the T cell binding motifs known in the art. Preferred embodiments contain no insertions, deletions or substitutions either within the motifs or within the intervening sequences of the polypeptides. In addition, embodiments which include a number of either N-terminal and/or C-terminal amino acid residues on either side of these motifs may be desirable (to, for example, include a greater portion of the polypeptide architecture in which the motif is located). Typically, the number of N-terminal and/or C-terminal amino acid residues on either side of a motif is between about 1 to about 100 amino acid residues, preferably 5 to about 50 amino acid residues.

282P1G3-related proteins are embodied in many forms, preferably in isolated form. A purified 282P1G3 protein molecule will be substantially free of other proteins or molecules that impair the binding of 282P1G3 to antibody, T cell or other ligand. The nature and degree of isolation and purification will depend on the intended use. Embodiments of a 282P1G3-related proteins include purified 282P1G3-related proteins and functional, soluble 282P1G3-related proteins. In one embodiment, a functional, soluble 282P1G3 protein or fragment thereof retains the ability to be bound by antibody, T cell or other ligand.

The invention also provides 282P1G3 proteins comprising biologically active fragments of a 282P1G3 amino acid sequence shown in FIG. 2 or FIG. 3. Such proteins exhibit properties of the starting 282P1G3 protein, such as the ability to elicit the generation of antibodies that specifically bind an epitope associated with the starting 282P1G3 protein; to be bound by such antibodies; to elicit the activation of HTL or CTL; and/or, to be recognized by HTL or CTL that also specifically bind to the starting protein.

282P1G3-related polypeptides that contain particularly interesting structures can be predicted and/or identified using various analytical techniques well known in the art, including, for example, the methods of Chou-Fasman, Gamier-Robson, Kyte-Doolittle, Eisenberg, Karplus-Schultz or Jameson-Wolf analysis, or based on immunogenicity. Fragments that contain such structures are particularly useful in generating subunit-specific anti-282P1G3 antibodies or T cells or in identifying cellular factors that bind to 282P1G3. For example, hydrophilicity profiles can be generated, and immunogenic peptide fragments identified, using the method of Hopp, T. P. and Woods, K. R., 1981, Proc. Natl. Acad. Sci. U.S.A. 78:3824–3828. Hydropathicity profiles can be generated, and immunogenic peptide fragments identified, using the method of Kyte, J. and Doolittle, R. F., 1982, J. Mol. Biol. 157:105–132. Percent (%) Accessible Residues profiles can be generated, and immunogenic peptide fragments identified, using the method of Janin J., 1979, Nature 277:491–492. Average Flexibility profiles can be generated, and immunogenic peptide fragments identified, using the method of Bhaskaran R., Ponnuswamy P. K., 1988, Int. J. Pept. Protein Res. 32:242–255. Beta-turn profiles can be generated, and immunogenic peptide fragments identified, using the method of Deleage, G., Roux B., 1987, Protein Engineering 1:289–294.

CTL epitopes can be determined using specific algorithms to identify peptides within a 282P1G3 protein that are capable of optimally binding to specified HLA alleles (e.g., by using the World Wide Web SYFPEITHI site, the listings in Table IV(A)–(E); Epimatrix™ and Epimer™, Brown University, and BIMAS. Illustrating this, peptide epitopes from 282P1G3 that are presented in the context of human MHC Class I molecules, e.g., HLA-A1, A2, A3, A11, A24, B7 and B35 were predicted (see, e.g., Tables VIII–XXI, XXII–XLIX). Specifically, the complete amino acid sequence of the 282P1G3 protein and relevant portions of other variants, i.e., for HLA Class I predictions 9 flanking residues on either side of a point mutation or exon juction, and for HLA Class II predictions 14 flanking residues on either side of a point mutation or exon junction corresponding to that variant, were entered into the HLA Peptide Motif Search algorithm found in the Bioinformatics and Molecular Analysis Section (BIMAS) web site listed above; in addition to the site SYFPEITHI.

The HLA peptide motif search algorithm was developed by Dr. Ken Parker based on binding of specific peptide sequences in the groove of HLA Class I molecules, in particular HLA-A2 (see, e.g., Falk et al., Nature 351: 290–6 (1991); Hunt et al., Science 255:1261–3(1992); Parker et al., J. Immunol. 149:3580–7(1992); Parker et al., J. Immunol. 152:163–75 (1994)). This algorithm allows location and ranking of 8-mer, 9-mer, and 10-mer peptides from a complete protein sequence for predicted binding to HLA-A2 as well as numerous other HLA Class I molecules. Many HLA class I binding peptides are 8-, 9-, 10 or 11-mers. For example, for Class I HLA-A2, the epitopes preferably contain a leucine (L) or methionine (M) at position 2 and a valine (V) or leucine (L) at the C-terminus (see, e.g., Parker et al., J. Immunol. 149:3580–7 (1992)). Selected results of 282P1G3 predicted binding peptides are shown in Tables VIII–XXI and XXII–XLIX herein. In Tables VIII–XXI and XXII–XLVII, selected candidates, 9-mers and 10-mers, for each family member are shown along with their location, the amino acid sequence of each specific peptide, and an estimated binding score. In Tables XLVI–XLIX, selected candidates, 15-mers, for each family member are shown along with their location, the amino acid sequence of each specific peptide, and an estimated binding score. The binding score corresponds to the estimated half time of dissociation of complexes containing the peptide at 37° C. at pH 6.5. Peptides with the highest binding score are predicted to be the most tightly bound to HLA Class I on the cell surface for the greatest period of time and thus represent the best immunogenic targets for T-cell recognition.

Actual binding of peptides to an HLA allele can be evaluated by stabilization of HLA expression on the antigen-processing defective cell line T2 (see, e.g., Xue et al., Prostate 30:73–8 (1997) and Peshwa et al., Prostate 36:129–38 (1998)). Immunogenicity of specific peptides can be evaluated in vitro by stimulation of CD8+ cytotoxic T lymphocytes (CTL) in the presence of antigen presenting cells such as dendritic cells.

It is to be appreciated that every epitope predicted by the BIMAS site, Epimer™ and Epimatrix™ sites, or specified by the HLA class I or class II motifs available in the art or which become part of the art such as set forth in Table IV (or determined using BIMAS) are to be "applied" to a 282P1G3 protein in accordance with the invention. As used in this context "applied" means that a 282P1G3 protein is evaluated, e.g., visually or by computer-based patterns finding methods, as appreciated by those of skill in the relevant art. Every subsequence of a 282P1G3 protein of 8, 9, 10, or 11 amino acid residues that bears an HLA Class I motif, or a subsequence of 9 or more amino acid residues that bear an HLA Class II motif are within the scope of the invention.

III.B.) Expression of 282P1G3-related Proteins

In an embodiment described in the examples that follow, 282P1G3 can be conveniently expressed in cells (such as 293T cells) transfected with a commercially available expression vector such as a CMV-driven expression vector encoding 282P1G3 with a C-terminal 6×His and MYC tag (pcDNA3.1/mycHIS, Invitrogen or Tag5, GenHunter Corporation, Nashville Tenn.). The Tag5 vector provides an IgGK secretion signal that can be used to facilitate the production of a secreted 282P1G3 protein in transfected cells. The secreted HIS-tagged 282P1G3 in the culture media can be purified, e.g., using a nickel column using standard techniques.

III.C.) Modifications of 282P1G3-related Proteins

Modifications of 282P1G3-related proteins such as covalent modifications are included within the scope of this invention. One type of covalent modification includes reacting targeted amino acid residues of a 282P1G3 polypeptide with an organic derivatizing agent that is capable of reacting with selected side chains or the N- or C-terminal residues of a 282P1G3 protein. Another type of covalent modification of a 282P1G3 polypeptide included within the scope of this invention comprises altering the native glycosylation pattern of a protein of the invention. Another type of covalent modification of 282P1G3 comprises linking a 282P1G3 polypeptide to one of a variety of nonproteinaceous polymers, e.g., polyethylene glycol (PEG), polypropylene glycol, or polyoxyalkylenes, in the manner set forth in U.S. Pat. Nos. 4,640,835; 4,496,689; 4,301,144; 4,670,417; 4,791,192 or 4,179,337.

The 282P1G3-related proteins of the present invention can also be modified to form a chimeric molecule comprising 282P1G3 fused to another, heterologous polypeptide or amino acid sequence. Such a chimeric molecule can be synthesized chemically or recombinantly. A chimeric molecule can have a protein of the invention fused to another tumor-associated antigen or fragment thereof. Alternatively, a protein in accordance with the invention can comprise a fusion of fragments of a 282P1G3 sequence (amino or nucleic acid) such that a molecule is created that is not, through its length, directly homologous to the amino or nucleic acid sequences shown in FIG. 2 or FIG. 3. Such a chimeric molecule can comprise multiples of the same subsequence of 282P1G3. A chimeric molecule can comprise a fusion of a 282P1G3-related protein with a polyhistidine epitope tag, which provides an epitope to which immobilized nickel can selectively bind, with cytokines or with growth factors. The epitope tag is generally placed at the amino- or carboxyl- terminus of a 282P1G3 protein. In an alternative embodiment, the chimeric molecule can comprise a fusion of a 282P1G3-related protein with an immunoglobulin or a particular region of an immunoglobulin. For a bivalent form of the chimeric molecule (also referred to as an "immunoadhesin"), such a fusion could be to the Fc region of an IgG molecule. The Ig fusions preferably include the substitution of a soluble (transmembrane domain deleted or inactivated) form of a 282P1G3 polypeptide in place of at least one variable region within an Ig molecule. In a preferred embodiment, the immunoglobulin fusion includes the hinge, CH2 and CH3, or the hinge, CHI, CH2 and CH3 regions of an IgGI molecule. For the production of immunoglobulin fusions see, e.g., U.S. Pat. No. 5,428,130 issued Jun. 27, 1995.

III.D.) Uses of 282P1G3-related Proteins

The proteins of the invention have a number of different specific uses. As 282P1G3 is highly expressed in prostate and other cancers, 282P1G3-related proteins are used in methods that assess the status of 282P1G3 gene products in normal versus cancerous tissues, thereby elucidating the malignant phenotype. Typically, polypeptides from specific regions of a 282P1G3 protein are used to assess the presence of perturbations (such as deletions, insertions, point mutations etc.) in those regions (such as regions containing one or more motifs). Exemplary assays utilize antibodies or T cells targeting 282P1G3-related proteins comprising the amino acid residues of one or more of the biological motifs contained within a 282P1G3 polypeptide sequence in order to evaluate the characteristics of this region in normal versus cancerous tissues or to elicit an immune response to the epitope. Alternatively, 282P1G3-related proteins that contain the amino acid residues of one or more of the biological motifs in a 282P1G3 protein are used to screen for factors that interact with that region of 282P1G3.

282P1G3 protein fragments/subsequences are particularly useful in generating and characterizing domain-specific antibodies (e.g., antibodies recognizing an extracellular or intracellular epitope of a 282P1G3 protein), for identifying agents or cellular factors that bind to 282P1G3 or a particular structural domain thereof, and in various therapeutic and diagnostic contexts, including but not limited to diagnostic assays, cancer vaccines and methods of preparing such vaccines.

Proteins encoded by the 282P1G3 genes, or by analogs, homologs or fragments thereof, have a variety of uses, including but not limited to generating antibodies and in methods for identifying ligands and other agents and cellular constituents that bind to a 282P1G3 gene product. Antibodies raised against a 282P1G3 protein or fragment thereof are useful in diagnostic and prognostic assays, and imaging methodologies in the management of human cancers characterized by expression of 282P1G3 protein, such as those listed in Table I. Such antibodies can be expressed intracellularly and used in methods of treating patients with such cancers. 282P1G3-related nucleic acids or proteins are also used in generating HTL or CTL responses.

Various immunological assays useful for the detection of 282P1G3 proteins are used, including but not limited to various types of radioimmunoassays, enzyme-linked immunosorbent assays (ELISA), enzyme-linked immunofluorescent assays (ELIFA), immunocytochemical methods, and the like. Antibodies can be labeled and used as immunological imaging reagents capable of detecting 282P1G3-expressing cells (e.g., in radioscintigraphic imaging methods). 282P1G3 proteins are also particularly useful in generating cancer vaccines, as further described herein.

IV.) 282P1G3 Antibodies

Another aspect of the invention provides antibodies that bind to 282P1G3-related proteins. Preferred antibodies specifically bind to a 282P1G3-related protein and do not bind (or bind weakly) to peptides or proteins that are not 282P1G3-related proteins under physiological conditions. In this context, examples of physiological conditions include: 1) phosphate buffered saline; 2) Tris-buffered saline containing 25 mM Tris and 150 mM NaCl; or normal saline (0.9% NaCl); 4) animal serum such as human serum; or, 5) a combination of any of 1) through 4); these reactions preferably taking place at pH 7.5, alternatively in a range of pH 7.0 to 8.0, or altematively in a range of pH 6.5 to 8.5; also, these reactions taking place at a temperature between 4° C. to 37° C. For example, antibodies that bind 282P1G3 can bind 282P1G3-related proteins such as the homologs or analogs thereof.

282P1G3 antibodies of the invention are particularly useful in cancer (see, e.g., Table I) diagnostic and prognostic assays, and imaging methodologies. Similarly, such antibodies are useful in the treatment, diagnosis, and/or prognosis of other cancers, to the extent 282P1G3 is also expressed or overexpressed in these other cancers. Moreover, intracellularly expressed antibodies (e.g., single chain antibodies) are therapeutically useful in treating cancers in which the expression of 282P1G3 is involved, such as advanced or metastatic prostate cancers.

The invention also provides various immunological assays useful for the detection and quantification of 282P1G3 and mutant 282P1G3-related proteins. Such assays can comprise one or more 282P1G3 antibodies capable of recognizing and binding a 282P1G3-related protein, as appropriate. These assays are performed within various immunological assay formats well known in the art, including but not limited to various types of radioimmunoassays, enzyme-linked immunosorbent assays (ELISA), enzyme-linked immunofluorescent assays (ELIFA), and the like.

Immunological non-antibody assays of the invention also comprise T cell immunogenicity assays (inhibitory or stimulatory) as well as major histocompatibility complex (MHC) binding assays.

In addition, immunological imaging methods capable of detecting prostate cancer and other cancers expressing 282P1G3 are also provided by the invention, including but not limited to radioscintigraphic imaging methods using labeled 282P1G3 antibodies. Such assays are clinically useful in the detection, monitoring, and prognosis of 282P1G3 expressing cancers such as prostate cancer.

282P1G3 antibodies are also used in methods for purifying a 282P1G3-related protein and for isolating 283P1G3 homologues and related molecules. For example, a method of purifying a 282P1G3-related protein comprises incubating a 282P1G3 antibody, which has been coupled to a solid matrix, with a lysate or other solution containing a 282P1G3-related protein under conditions that permit the 282P1G3 antibody to bind to the 282P1G3-related protein; washing the solid matrix to eliminate impurities; and eluting the 282P1G3-related protein from the coupled antibody. Other uses of 282P1G3 antibodies in accordance with the invention include generating anti-idiotypic antibodies that mimic a 282P1G3 protein.

Various methods for the preparation of antibodies are well known in the art. For example, antibodies can be prepared by immunizing a suitable mammalian host using a 282P1G3-related protein, peptide, or fragment, in isolated or immunoconjugated form (Antibodies: A Laboratory Manual, CSH Press, Eds., Harlow, and Lane (1988); Harlow, Antibodies, Cold Spring Harbor Press, N.Y. (1989)). In addition, fusion proteins of 282P1G3 can also be used, such as a 282P1G3 GST-fusion protein. In a particular embodiment, a GST fusion protein comprising all or most of the amino acid sequence of FIG. 2 or FIG. 3 is produced, then used as an immunogen to generate appropriate antibodies. In another embodiment, a 282P1G3-related protein is synthesized and used as an immunogen.

In addition, naked DNA immunization techniques known in the art are used (with or without purified 282P1G3-related protein or 282P1G3 expressing cells) to generate an immune response to the encoded immunogen (for review, see Donnelly et al., 1997, Ann. Rev. Immunol. 15: 617–648).

The amino acid sequence of a 282P1G3 protein as shown in FIG. 2 or FIG. 3 can be analyzed to select specific regions of the 282P1G3 protein for generating antibodies. For example, hydrophobicity and hydrophilicity analyses of a 283P1G3 amino acid sequence are used to identify hydrophilic regions in the 282P1G3 structure. Regions of a 282P1G3 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Hydrophilicity profiles can be generated using the method of Hopp, T. P. and Woods, K. R., 1981, Proc. Natl. Acad. Sci. U.S.A. 78:3824–3828. Hydropathicity profiles can be generated using the method of Kyte, J. and Doolittle, R. F., 1982, J. Mol. Biol. 157:105–132. Percent (%) Accessible Residues profiles can be generated using the method of Janin J., 1979, Nature 277:491–492. Average Flexibility profiles can be generated using the method of Bhaskaran R., Ponnuswamy P. K., 1988, Int. J. Pept. Protein Res. 32:242–255. Beta-turn profiles can be generated using the method of Deleage, G., Roux B., 1987, Protein Engineering 1:289–294. Thus, each region identified by any of these programs or methods is within the scope of the present invention. Methods for the generation of 282P1G3 antibodies are further illustrated by way of the examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents such as those supplied by Pierce Chemical Co., Rockford, Ill., are effective. Administration of a 282P1G3 immunogen is often conducted by injection over a suitable time period and with use of a suitable adjuvant, as is understood in the art During the immunization schedule, titers of antibodies can be taken to determine adequacy of antibody formation.

282P1G3 monoclonal antibodies can be produced by various means well known in the art. For example, immortalized cell lines that secrete a desired monoclonal antibody are prepared using the standard hybridoma technology of Kohler and Milstein or modifications that immortalize antibody-producing B cells, as is generally known. Immortalized cell lines that secrete the desired antibodies are screened by immunoassay in which the antigen is a 282P1G3-related protein. When the appropriate immortalized cell culture is identified, the cells can be expanded and antibodies produced either from in vitro cultures or from ascites fluid.

The antibodies or fragments of the invention can also be produced, by recombinant means. Regions that bind specifically to the desired regions of a 282P1G3 protein can also be produced in the context of chimeric or complementarity-determining region (CDR) grafted antibodies of multiple species origin. Humanized or human 282P1G3 antibodies can also be produced, and are preferred for use in therapeutic contexts. Methods for humanizing murine and other non-human antibodies, by substituting one or more of the non-human antibody CDRs for corresponding human antibody sequences, are well known (see for example, Jones et al., 1986, Nature 321: 522–525; Riechmann et al., 1988, Nature 332: 323–327; Verhoeyen et al., 1988, Science 239: 1534–1536). See also, Carter et al., 1993, Proc. Natl. Acad. Sci. USA 89: 4285 and Sims et al., 1993, J. Immunol. 151:2296.

Methods for producing fully human monoclonal antibodies include phage display and transgenic methods (for review, see Vaughan et al., 1998, Nature Biotechnology 16: 535–539). Fully human 282P1G3 monoclonal antibodies can be generated using cloning technologies employing large human Ig gene combinatorial libraries (i.e., phage display) (Griffiths and Hoogenboom, Building an in vitro immune system: human antibodies from phage display libraries. In: Protein Engineering of Antibody Molecules for Prophylactic and Therapeutic Applications in Man, Clark, M. (Ed.), Nottingham Academic, pp 45–64 (1993); Burton and Barbas, Human Antibodies from combinatorial libraries. Id., pp 65–82). Fully human 282P1G3 monoclonal antibodies can also be produced using transgenic mice engineered to contain human immunoglobulin gene loci as described in PCT Patent Application WO98/24893, Kucherlapati and Jakobovits et al., published Dec. 3, 1997 (see also, Jakobovits, 1998, Exp. Opin. Invest. Drugs 7(4): 607–614; U.S. Pat. No. 6,162,963 issued 19 Dec. 2000; U.S. Pat. No. 6,150,584 issued 12 Nov. 2000; and U.S. Pat. No. 6,114,598 issued 5 Sep. 2000). This method avoids the in vitro manipulation required with phage display technology and efficiently produces high affinity authentic human antibodies.

Reactivity of 282P1G3 antibodies with a 282P1G3-related protein can be established by a number of well known means, including Western blot, immunoprecipitation, ELISA, and FACS analyses using, as appropriate, 282P1G3-related proteins, 282P1G3-expressing cells or extracts thereof. A 282P1G3 antibody or fragment thereof can be labeled with a detectable marker or conjugated to a second molecule. Suitable detectable markers include, but are not limited to, a radioisotope, a fluorescent compound, a bioluminescent compound, chemiluminescent compound, a metal chelator or an enzyme. Further, bi-specific antibodies specific for two or more 282P1G3 epitopes are generated using methods generally known in the art. Homodimeric antibodies can also be generated by cross-linking techniques known in the art (e.g., Wolff et al., Cancer Res. 53: 2560–2565).

V.) 282P1G3 Cellular Immune Responses

The mechanism by which T cells recognize antigens has been delineated. Efficacious peptide epitope vaccine compositions of the invention induce a therapeutic or prophylactic immune responses in very broad segments of the world-wide population. For an understanding of the value and efficacy of compositions of the invention that induce cellular immune responses, a brief review of immunology-related technology is provided.

A complex of an HLA molecule and a peptidic antigen acts as the ligand recognized by HLA-restricted T cells (Buus, S. et al., Cell 47:1071, 1986; Babbitt, B. P. et al., Nature 317:359, 1985; Townsend, A. and Bodmer, H., Annu. Rev. Immunol. 7:601, 1989; Germain, R. N., Annu. Rev. Immunol. 11:403, 1993). Through the study of single amino acid substituted antigen analogs and the sequencing of endogenously bound, naturally processed peptides, critical residues that correspond to motifs required for specific binding to HLA antigen molecules have been identified and are set forth in Table IV (see also, e.g., Southwood, et al., J. Immunol. 160:3363, 1998; Rammensee, et al., Immunogenetics 41:178, 1995; Rammensee et al., SYFPEITHI; Sette, A. and Sidney, J. Curr. Opin. Inimunol. 10:478, 1998; Engelhard, V. H., Curr. Opin. Immunol. 6:13, 1994; Sette, A. and Grey, H. M., Curr. Opin. Immunol. 4:79, 1992; Sinigaglia, F. and Hammer, J. Curr. Biol. 6:52, 1994; Ruppert et al., Cell 74:929–937, 1993; Kondo et al., J. Immunol. 155:4307–4312, 1995; Sidney et al., J. Immunol. 157: 3480–3490, 1996; Sidney et al., Human Immunol. 45:79–93, 1996; Sette, A. and Sidney, J. Immunogenetics 1999 November; 50(3–4):201–12, Review).

Furthermore, x-ray crystallographic analyses of HLA-peptide complexes have revealed pockets within the peptide binding cleft/groove of HLA molecules which accommodate, in an allele-specific mode, residues borne by peptide ligands; these residues in turn determine the HLA binding capacity of the peptides in which they are present. (See, e.g., Madden, D. R. *Annu. Rev. Immunol.* 13:587, 1995; Smith, et al., *Immunity* 4:203, 1996; Fremont et al., *Immunity* 8:305, 1998; Stern et al., *Structure* 2:245, 1994; Jones, E. Y. *Curr. Opin. Immunol.* 9:75, 1997; Brown, J. H. et al., *Nature* 364:33, 1993; Guo, H. C. et al., *Proc. Natl. Acad. Sci. USA* 90:8053, 1993; Guo, H. C. et al., *Nature* 360:364, 1992; Silver, M. L. et al., *Nature* 360:367, 1992; Matsumura, M. et al., *Science* 257:927, 1992; Madden et al., *Cell* 70:1035, 1992; Fremont, D. H. et al., *Science* 257:919, 1992; Saper, M. A., Bjorkman, P. J. and Wiley, D. C., *J. Mol. Biol.* 219:277, 1991.)

Accordingly, the definition of class I and class II allele-specifc HLA binding motifs, or class I or class II supermotifs allows identification of regions within a protein that are correlated with binding to particular HLA antigen(s).

Thus, by a process of HLA motif identification, candidates for epitope-based vaccines have been identified; such candidates can be further evaluated by HLA-peptide binding assays to determine binding affinity and/or the time period of association of the epitope and its corresponding HLA molecule. Additional confirmatory work can be performed to select, amongst these vaccine candidates, epitopes with preferred characteristics in terms of population coverage, and/or immunogenicity.

Various strategies can be utilized to evaluate cellular immunogenicity, including:

1) Evaluation of primary T cell cultures from normal individuals (see, e.g., Wentworth, P. A. et al., *Mol. Immunol.* 32:603, 1995; Celis, E. et al., *Proc. Natl. Acad. Sci. USA* 91:2105, 1994; Tsai, V. et al., *J. Immunol.* 158:1796, 1997; Kawashima, I. et al., *Human Immunol.* 59:1, 1998). This procedure involves the stimulation of peripheral blood lymphocytes (PBL) from normal subjects with a test peptide in the presence of antigen presenting cells in vitro over a period of several weeks. T cells specific for the peptide become activated during this time and are detected using, e.g., a lymphokine- or $^{51}$Cr-release assay involving peptide sensitized target cells.

2) Immunization of HLA transgenic mice (see, e.g., Wentworth, P. A. et al., *J. Immunol.* 26:97, 1996; Wentworth, P. A. et al., *Int. Immunol.* 8:651, 1996; Alexander, J. et al., *J. Immunol.* 159:4753, 1997). For example, in such methods peptides in incomplete Freund's adjuvant are administered subcutaneously to HLA transgenic mice. Several weeks following immunization, splenocytes are removed and cultured in vitro in the presence of test peptide for approximately one week. Peptide-specific T cells are detected using, e.g., a $^{51}$Cr-release assay involving peptide sensitized target cells and target cells expressing endogenously generated antigen.

3) Demonstration of recall T cell responses from immune individuals who have been either effectively vaccinated and/or from chronically ill patients (see, e.g., Rehermann, B. et al., *J. Exp. Med.* 181:1047, 1995; Doolan, D. L. et al., *Immunity* 7:97, 1997; Bertoni, R. et al., *J. Clin. Invest* 100:503, 1997; Threlkeld, S. C. et al., *J. Immunol.* 159:1648, 1997; Diepolder, H. M. et al., *J. Virol.* 71:6011, 1997). Accordingly, recall responses are detected by culturing PBL from subjects that have been exposed to the antigen due to disease and thus have generated an immune response "naturally", or from patients who were vaccinated against the antigen. PBL from subjects are cultured in vitro for 1–2 weeks in the presence of test peptide plus antigen presenting cells (APC) to allow activation of "memory" T cells, as compared to "naive" T cells. At the end of the culture period, T cell activity is detected using assays including $^{51}$Cr release involving peptide-sensitized targets, T cell proliferation, or lymphokine release.

VI.) 282P1G3 Transgenic Animals

Nucleic acids that encode a 282P1G3-related protein can also be used to generate either transgenic animals or "knock out" animals that, in turn, are useful in the development and screening of therapeutically useful reagents. In accordance with established techniques, cDNA encoding 282P1G3 can be used to clone genomic DNA that encodes 282P1G3. The cloned genomic sequences can then be used to generate transgenic animals containing cells that express DNA that encode 282P1G3. Methods for generating transgenic animals, particularly animals such as mice or rats, have become conventional in the art and are described, for example, in U.S. Pat. No. 4,736,866 issued 12 Apr. 1988, and U.S. Pat. No. 4,870,009 issued 26 Sep. 1989. Typically, particular cells would be targeted for 282P1G3 transgene incorporation with tissue-specific enhancers.

Transgenic animals that include a copy of a transgene encoding 282P1G3 can be used to examine the effect of increased expression of DNA that encodes 282P1G3. Such animals can be used as tester animals for reagents thought to confer protection from, for example, pathological conditions associated with its overexpression. In accordance with this aspect of the invention, an animal is treated with a reagent and a reduced incidence of a pathological condition, compared to untreated animals that bear the transgene, would indicate a potential therapeutic intervention for the pathological condition.

Alternatively, non-human homologues of 282P1G3 can be used to construct a 282P1G3 "knock out" animal that has a defective or altered gene encoding 282P1G3 as a result of homologous recombination between the endogenous gene encoding 282P1G3 and altered genomic DNA encoding 282P1G3 introduced into an embryonic cell of the animal. For example, cDNA that encodes 282P1G3 can be used to clone genomic DNA encoding 282P1G3 in accordance with established techniques. A portion of the genomic DNA encoding 282P1G3 can be deleted or replaced with another gene, such as a gene encoding a selectable marker that can be used to monitor integration. Typically, several kilobases of unaltered flanking DNA (both at the 5' and 3' ends) are included in the vector (see, e.g., Thomas and Capecchi, *Cell*, 51:503 (1987) for a description of homologous recombination vectors). The vector is introduced into an embryonic stem cell line (e.g., by electroporation) and cells in which the introduced DNA has homologously recombined with the endogenous DNA are selected (see, e.g., Li et al., *Cell*, 69:915(1992)). The selected cells are then injected into a blastocyst of an animal (e.g., a mouse or rat) to form aggregation chimeras (see, e.g., Bradley, in *Teratocarcino-*

*mas and Embryonic Stem Cells: A Practical Approach*, E. J. Robertson, ed. (IRL, Oxford, 1987), pp. 113–152). Achimeric embryo can then be implanted into a suitable pseudopregnant female foster animal, and the embryo brought to term to create a "knock out" animal. Progeny harboring the homologously recombined DNA in their germ cells can be identified by standard techniques and used to breed animals in which all cells of the animal contain the homologously recombined DNA. Knock out animals can be characterized, for example, for their ability to defend against certain pathological conditions or for their development of pathological conditions due to absence of a 282P1G3 polypeptide.

VII.) Methods for the Detection of 282P1G3

Another aspect of the present invention relates to methods for detecting 282P1G3 polynucleotides and 282P1G3-related proteins, as well as methods for identifying a cell that expresses 282P1G3. The expression profile of 282P1G3 makes it a diagnostic marker for metastasized disease. Accordingly, the status of 282P1G3 gene products provides information useful for predicting a variety of factors including susceptibility to advanced stage disease, rate of progression, and/or tumor aggressiveness. As discussed in detail herein, the status of 282P1G3 gene products in patient samples can be analyzed by a variety protocols that are well known in the art including immunohistochemical analysis, the variety of Northern blotting techniques including in situ hybridization, RT-PCR analysis (for example on laser capture micro-dissected samples), Western blot analysis and tissue array analysis.

More particularly, the invention provides assays for the detection of 282P1G3 polynucleotides in a biological sample, such as serum, bone, prostate, and other tissues, urine, semen, cell preparations, and the like. Detectable 282P1G3 polynucleotides include, for example, a 282P1G3 gene or fragment thereof, 282P1G3 mRNA, alternative splice variant 282P1G3 mRNAs, and recombinant DNA or RNA molecules that contain a 282P1G3 polynucleotide. A number of methods for amplifying and/or detecting the presence of 282P1G3 polynucleotides are well known in the art and can be employed in the practice of this aspect of the invention.

In one embodiment, a method for detecting a 282P1G3 mRNA in a biological sample comprises producing cDNA from the sample by reverse transcription using at least one primer; amplifying the cDNA so produced using a 282P1G3 polynucleotides as sense and antisense primers to amplify 282P1G3 cDNAs therein; and detecting the presence of the amplified 282P1G3 cDNA. Optionally, the sequence of the amplified 282P1G3 cDNA can be determined.

In another embodiment, a method of detecting a 282P1G3 gene in a biological sample comprises first isolating genomic DNA from the sample; amplifying the isolated genomic DNA using 282P1G3 polynucleotides as sense and antisense primers; and detecting the presence of the amplified 282P1G3 gene. Any number of appropriate sense and antisense probe combinations can be designed from a 282P1G3 nucleotide sequence (see, e.g., FIG. 2) and used for this purpose.

The invention also provides assays for detecting the presence of a 282P1G3 protein in a tissue or other biological sample such as serum, semen, bone, prostate, urine, cell preparations, and the like. Methods for detecting a 282P1G3-related protein are also well known and include, for example, immunoprecipitation, immunohistochemical analysis, Western blot analysis, molecular binding assays, ELISA, ELIFA and the like. For example, a method of detecting the presence of a 282P1G3-related protein in a biological sample comprises first contacting the sample with a 282P1G3 antibody, a 282P1G3-reactive fragment thereof, or a recombinant protein containing an antigen-binding region of a 282P1G3 antibody; and then detecting the binding of 282P1G3-related protein in the sample.

Methods for identifying a cell that expresses 282P1G3 are also within the scope of the invention. In one embodiment, an assay for identifying a cell that expresses a 282P1G3 gene comprises detecting the presence of 282P1G3 mRNA in the cell. Methods for the detection of particular mRNAs in cells are well known and include, for example, hybridization assays using complementary DNA probes (such as in situ hybridization using labeled 282P1G3 riboprobes, Northem blot and related techniques) and various nucleic acid amplification assays (such as RT-PCR using complementary primers specific for 282P1G3, and other amplification type detection methods, such as, for example, branched DNA, SISBA, TMA and the like). Alternatively, an assay for identifying a cell that expresses a 282P1G3 gene comprises detecting the presence of 282P1G3-related protein in the cell or secreted by the cell. Various methods for the detection of proteins are well known in the art and are employed for the detection of 282P1G3-related proteins and cells that express 282P1G3-related proteins.

282P1G3 expression analysis is also useful as a tool for identifying and evaluating agents that modulate 282P1G3 gene expression. For example, 282P1G3 expression is significantly upregulated in prostate cancer, and is expressed in cancers of the tissues listed in Table I. Identification of a molecule or biological agent that inhibits 282P1G3 expression or over-expression in cancer cells is of therapeutic value. For example, such an agent can be identified by using a screen that quantifies 282P1G3 expression by RT-PCR, nucleic acid hybridization or antibody binding.

VIII.) Methods for Monitoring the Status of 282P1G3-related Genes and Their Products Oncogenesis is known to be a multistep process where cellular growth becomes progressively dysregulated and cells progress from a normal physiological state to precancerous and then cancerous states (see, e.g., Alers et al., Lab Invest. 77(5): 437–438 (1997) and Isaacs et al., Cancer Surv. 23: 19–32 (1995)). In this context, examining a biological sample for evidence of dysregulated cell growth (such as aberrant 282P1G3 expression in cancers) allows for early detection of such aberrant physiology, before a pathologic state such as cancer has progressed to a stage that therapeutic options are more limited and or the prognosis is worse. In such examinations, the status of 282P1G3 in a biological sample of interest can be compared, for example, to the status of 282P1G3 in a corresponding normal sample (e.g. a sample from that individual or alternatively another individual that is not affected by a pathology). An alteration in the status of 282P1G3 in the biological sample (as compared to the normal sample) provides evidence of dysregulated cellular growth. In addition to using a biological sample that is not affected by a pathology as a normal sample, one can also use a predetermined normative value such as a predetermined normal level of mRNA expression (see, e.g., Grever et al., J. Comp. Neurol. 1996 Dec. 9; 376(2): 306–14 and U.S. Pat. No. 5,837,501) to compare 282P1G3 status in a sample.

The term "status" in this context is used according to its art accepted meaning and refers to the condition or state of a gene and its products. Typically, skilled artisans use a number of parameters to evaluate the condition or state of a gene and its products. These include, but are not limited to the location of expressed gene products (including the location of 282P1G3 expressing cells) as well as the level, and biological activity of expressed gene products (such as 282P1G3 mRNA, polynucleotides and polypeptides). Typically, an alteration in the status of 282P1G3 comprises a change in the location of 282P1G3 and/or 282P1G3 expressing cells and/or an increase in 282P1G3 mRNA and/or protein expression.

282P1G3 status in a sample can be analyzed by a number of means well known in the art, including without limitation, immunohistochemical analysis, in situ hybridization, RT-PCR analysis on laser capture micro-dissected samples, Western blot analysis, and tissue array analysis. Typical protocols for evaluating the status of a 282P1G3 gene and gene products are found for example in Ausubel et al. eds., 1995, Current Protocols In Molecular Biology, Units 2 (Northern Blotting), 4 (Southern Blotting), 15 (Immunoblotting) and 18 (PCR Analysis). Thus, the status of 282P1G3 in a biological sample is evaluated by various methods utilized by skilled artisans including, but not limited to genomic Southern analysis (to examine, for example perturbations in a 282P1G3 gene), Northern analysis and/or PCR analysis of 282P1G3 mRNA (to examine, for example alterations in the polynucleotide sequences or expression levels of 282P1G3 mRNAs), and, Western and/or immunohistochemical analysis (to examine, for example alterations in polypeptide sequences, alterations in polypeptide localization within a sample, alterations in expression levels of 282P1G3 proteins and/or associations of 282P1G3 proteins with polypeptide binding partners). Detectable 282P1G3 polynucleotides include, for example, a 282P1G3 gene or fragment thereof, 282P1G3 mRNA, alternative splice variants, 282P1G3 mRNAs, and recombinant DNA or RNA molecules containing a 282P1G3 polynucleotide.

The expression profile of 282P1G3 makes it a diagnostic marker for local and/or metastasized disease, and provides information on the growth or oncogenic potential of a biological sample. In particular, the status of 282P1G3 provides information useful for predicting susceptibility to particular disease stages, progression, and/or tumor aggressiveness. The invention provides methods and assays for determining 282P1G3 status and diagnosing cancers that express 282P1G3, such as cancers of the tissues listed in Table I. For example, because 282P1G3 mRNA is so highly expressed in prostate and other cancers relative to normal prostate tissue, assays that evaluate the levels of 282P1G3 mRNA transcripts or proteins in a biological sample can be used to diagnose a disease associated with 282P1G3 dysregulation, and can provide prognostic information useful in defining appropriate therapeutic options.

The expression status of 282P1G3 provides information including the presence, stage and location of dysplastic, precancerous and cancerous cells, predicting susceptibility to various stages of disease, and/or for gauging tumor aggressiveness. Moreover, the expression profile makes it useful as an imaging reagent for metastasized disease. Consequently, an aspect of the invention is directed to the various molecular prognostic and diagnostic methods for examining the status of 282P1G3 in biological samples such as those from individuals suffering from, or suspected of suffering from a pathology characterized by dysregulated cellular growth, such as cancer.

As described above, the status of 282P1G3 in a biological sample can be examined by a number of well-known procedures in the art. For example, the status of 282P1G3 in a biological sample taken from a specific location in the body can be examined by evaluating the sample for the presence or absence of 282P1G3 expressing cells (e.g. those that express 282P1G3 mRNAs or proteins). This examination can provide evidence of dysregulated cellular growth, for example, when 282P1G3-expressing cells are found in a biological sample that does not normally contain such cells (such as a lymph node), because such alterations in the status of 282P1G3 in a biological sample are often associated with dysregulated cellular growth. Specifically, one indicator of dysregulated cellular growth is the metastases of cancer cells from an organ of origin (such as the prostate) to a different area of the body (such as a lymph node). In this context, evidence of dysregulated cellular growth is important for example because occult lymph node metastases can be detected in a substantial proportion of patients with prostate cancer, and such metastases are associated with known predictors of disease progression (see, e.g., Murphy et al., Prostate 42(4): 315–317 (2000);Su et al., Semin. Surg. Oncol. 18(1): 17–28 (2000) and Freeman et al., J Urol 1995 August 154(2 Pt 1):474–8).

In one aspect, the invention provides methods for monitoring 282P1G3 gene products by determining the status of 282P1G3 gene products expressed by cells from an individual suspected of having a disease associated with dysregulated cell growth (such as hyperplasia or cancer) and then comparing the status so determined to the status of 282P1G3 gene products in a corresponding normal sample. The presence of aberrant 282P1G3 gene products in the test sample relative to the normal sample provides an indication of the presence of dysregulated cell growth within the cells of the individual.

In another aspect, the invention provides assays useful in determining the presence of cancer in an individual, comprising detecting a significant increase in 282P1G3 mRNA or protein expression in a test cell or tissue sample relative to expression levels in the corresponding normal cell or tissue. The presence of 282P1G3 mRNA can, for example, be evaluated in tissues including but not limited to those listed in Table I. The presence of significant 282P1G3 expression in any of these tissues is useful to indicate the emergence, presence and/or severity of a cancer, since the corresponding normal tissues do not express 282P1G3 mRNA or express it at lower levels.

In a related embodiment, 282P1G3 status is determined at the protein level rather than at the nucleic acid level. For example, such a method comprises determining the level of 282P1G3 protein expressed by cells in a test tissue sample and comparing the level so determined to the level of 282P1G3 expressed in a corresponding normal sample. In one embodiment, the presence of 282P1G3 protein is evaluated, for example, using immunohistochemical methods. 282P1G3 antibodies or binding partners capable of detecting 282P1G3 protein expression are used in a variety of assay formats well known in the art for this purpose.

In a further embodiment, one can evaluate the status of 282P1G3 nucleotide and amino acid sequences in a biological sample in order to identify perturbations in the structure of these molecules. These perturbations can include insertions, deletions, substitutions and the like. Such evaluations are useful because perturbations in the nucleotide and amino acid sequences are observed in a large number of proteins associated with a growth dysregulated phenotype (see, e.g., Marrogi et al., 1999, J. Cutan. Pathol. 26(8):369–378). For example, a mutation in the sequence of 282P1G3 may be indicative of the presence or promotion of a tumor. Such assays therefore have diagnostic and predictive value where a mutation in 282P1G3 indicates a potential loss of function or increase in tumor growth.

A wide variety of assays for observing perturbations in nucleotide and amino acid sequences are well known in the art. For example, the size and structure of nucleic acid or amino acid sequences of 282P1G3 gene products are observed by the Northem, Southern, Westem, PCR and DNA sequencing protocols discussed herein. In addition, other methods for observing perturbations in nucleotide and amino acid sequences such as single strand conformation polymorphism analysis are well known in the art (see, e.g., U.S. Pat. No. 5,382,510 issued 7 Sep. 1999, and U.S. Pat. No. 5,952,170 issued 17 Jan. 1995).

Additionally, one can examine the methylation status of a 282P1G3 gene in a biological sample. Aberrant demethylation and/or hypermethylation of CpG islands in gene 5' regulatory regions frequently occurs in immortalized and transformed cells, and can result in altered expression of various genes. For example, promoter hypermethylation of the pi-class glutathione S-transferase (a protein expressed in normal prostate but not expressed in >90% of prostate carcinomas) appears to permanently silence transcription of this gene and is the most frequently detected genomic alteration in prostate carcinomas (De Marzo et al., Am. J. Pathol. 155(6): 1985–1992 (1999)). In addition, this alteration is present in at least 70% of cases of high-grade prostatic intraepithelial neoplasia (PIN) (Brooks et al., Cancer Epidemiol. Biomarkers Prev., 1998, 7:531–536). In another example, expression of the LAGE-I tumor specific gene (which is not expressed in normal prostate but is expressed in 25–50% of prostate cancers) is induced by deoxy-azacytidine in lymphoblastoid cells, suggesting that tumoral expression is due to demethylation (Lethe et al., Int. J. Cancer 76(6): 903–908 (1998)). A variety of assays for examining methylation status of a gene are well known in the art. For example, one can utilize, in Southern hybridization approaches, methylation-sensitive restriction enzymes that cannot cleave sequences that contain methylated CpG sites to assess the methylation status of CpG islands. In addition, MSP (methylation specific PCR) can rapidly profile the methylation status of all the CpG sites present in a CpG island of a given gene. This procedure involves initial modification of DNA by sodium bisulfite (which will convert all unmethylated cytosines to uracil) followed by amplification using primers specific for methylated versus unmethylated DNA. Protocols involving methylation interference can also be found for example in Current Protocols In Molecular Biology, Unit 12, Frederick M. Ausubel et al eds., 1995.

Gene amplification is an additional method for assessing the status of 282P1G3. Gene amplification is measured in a sample directly, for example, by conventional Southern blotting or Northern blotting to quantitate the transcription of mRNA (Thomas, 1980, Proc. Natl. Acad. Sci. USA, 77:5201–5205), dot blotting (DNA analysis), or in situ hybridization, using an appropriately labeled probe, based on the sequences provided herein. Alternatively, antibodies are employed that recognize specific duplexes, including DNA duplexes, RNA duplexes, and DNA-RNA hybrid duplexes or DNA-protein duplexes. The antibodies in turn are labeled and the assay carried out where the duplex is bound to a surface, so that upon the formation of duplex on the surface, the presence of antibody bound to the duplex can be detected.

Biopsied tissue or peripheral blood can be conveniently assayed for the presence of cancer cells using for example, Northern, dot blot or RT-PCR analysis to detect 282P1G3 expression. The presence of RT-PCR amplifiable 282P1G3 mRNA provides an indication of the presence of cancer. RT-PCR assays are well known in the art. RT-PCR detection assays for tumor cells in peripheral blood are currently being evaluated for use in the diagnosis and management of a number of human solid tumors. In the prostate cancer field, these include RT-PCR assays for the detection of cells expressing PSA and PSM (Verkaik et al., 1997, Urol. Res. 25:373–384; Ghossein et al., 1995, J. Clin. Oncol. 13:1195–2000; Heston et al., 1995, Clin. Chem. 41:1687–1688).

A further aspect of the invention is an assessment of the susceptibility that an individual has for developing cancer. In one embodiment, a method for predicting susceptibility to cancer comprises detecting 282P1G3 mRNA or 282P1G3 protein in a tissue sample, its presence indicating susceptibility to cancer, wherein the degree of 282P1G3 mRNA expression correlates to the degree of susceptibility. In a specific embodiment, the presence of 282P1G3 in prostate or other tissue is examined, with the presence of 282P1G3 in the sample providing an indication of prostate cancer susceptibility (or the emergence or existence of a prostate tumor). Similarly, one can evaluate the integrity 282P1G3 nucleotide and amino acid sequences in a biological sample, in order to identify perturbations in the structure of these molecules such as insertions, deletions, substitutions and the like. The presence of one or more perturbations in 282P1G3 gene products in the sample is an indication of cancer susceptibility (or the emergence or existence of a tumor).

The invention also comprises methods for gauging tumor aggressiveness. In one embodiment, a method for gauging aggressiveness of a tumor comprises determining the level of 282P1G3 mRNA or 282P1G3 protein expressed by tumor cells, comparing the level so determined to the level of 282P1G3 mRNA or 282P1G3 protein expressed in a corresponding normal tissue taken from the same individual or a normal tissue reference sample, wherein the degree of 282P1G3 mRNA or 282P1G3 protein expression in the tumor sample relative to the normal sample indicates the degree of aggressiveness. In a specific embodiment, aggressiveness of a tumor is evaluated by determining the extent to which 282P1G3 is expressed in the tumor cell, with higher expression levels indicating more aggressive tumors. Another embodiment is the evaluation of the integrity of 282P1G3 nucleotide and amino acid sequences in a biological sample, in order to identify perturbations in the structure of these molecules such as insertions, deletions, substitutions and the like. The presence of one or more perturbations indicates more aggressive tumors.

Another embodiment of the invention is directed to methods for observing the progression of a malignancy in an individual over time. In one embodiment, methods for observing the progression of a malignancy in an individual over time comprise determining the level of 282P1G3 mRNA or 282P1G3 protein expressed by cells in a sample of the tumor, comparing the level so determined to the level of 282P1G3 mRNA or 282P1G3 protein expressed in an equivalent tissue sample taken from the same individual at a different time, wherein the degree of 282P1G3 mRNA or 282P1G3 protein expression in the tumor sample over time provides information on the progression of the cancer. In a specific embodiment, the progression of a cancer is evaluated by determining 282P1G3 expression in the tumor cells over time, where increased expression over time indicates a progression of the cancer. Also, one can evaluate the integrity 282P1G3 nucleotide and amino acid sequences in a biological sample in order to identify perturbations in the structure of these molecules such as insertions, deletions, substitutions and the like, where the presence of one or more perturbations indicates a progression of the cancer.

The above diagnostic approaches can be combined with any one of a wide variety of prognostic and diagnostic protocols known in the art. For example, another embodiment of the invention is directed to methods for observing a coincidence between the expression of 282P1G3 gene and 282P1G3 gene products (or perturbations in 282P1G3 gene and 282P1G3 gene products) and a factor that is associated with malignancy, as a means for diagnosing and prognosticating the status of a tissue sample. A wide variety of factors associated with malignancy can be utilized, such as the expression of genes associated with malignancy (e.g. PSA, PSCA and PSM expression for prostate cancer etc.) as well as gross cytological observations (see, e.g., Bocking et al., 1984, Anal. Quant. Cytol. 6(2):74–88; Epstein, 1995, Hum. Pathol. 26(2):223–6; Thorson et al., 1988, Mod. Pathol. 11(6):543–51; Baisden et al., 1999, Am. J. Surg. Pathol. 23(8):918–24). Methods for observing a coincidence between the expression of 282P1G3 gene and 282P1G3 gene products (or perturbations in 282P1G3 gene and 282P1G3 gene products) and another factor that is associated with malignancy are useful, for example, because the presence of a set of specific factors that coincide with disease provides information crucial for diagnosing and prognosticating the status of a tissue sample.

In one embodiment, methods for observing a coincidence between the expression of 282P1G3 gene and 282P1G3 gene products (or perturbations in 282P1G3 gene and 282P1G3 gene products) and another factor associated with malignancy entails detecting the overexpression of 282P1G3 mRNA or protein in a tissue sample, detecting the overexpression of PSA mRNA or protein in a tissue sample (or PSCA or PSM expression), and observing a coincidence of 282P1G3 mRNA or protein and PSA mRNA or protein overexpression (or PSCA or PSM expression). In a specific embodiment, the expression of 282P1G3 and PSA mRNA in prostate tissue is examined, where the coincidence of 282P1G3 and PSA mRNA overexpression in the sample indicates the existence of prostate cancer, prostate cancer susceptibility or the emergence or status of a prostate tumor.

Methods for detecting and quantifying the expression of 282P1G3 mRNA or protein are described herein, and standard nucleic acid and protein detection and quantification technologies are well known in the art Standard methods for the detection and quantification of 282P1G3 mRNA include in situ hybridization using labeled 282P1G3 riboprobes, Northern blot and related techniques using 282P1G3 polynucleotide probes, RT-PCR analysis using primers specific for 282P1G3, and other amplification type detection methods, such as, for example, branched DNA, SISBA, TMA and the like. In a specific embodiment, semi-quantitative RT-PCR is used to detect and quantify 282PiG3 mRNA expression. Any number of primers capable of amplifying 282P1G3 can be used for this purpose, including but not limited to the various primer sets specifically described herein. In a specific embodiment, polyclonal or monoclonal antibodies specifically reactive with the wild-type 282P1G3 protein can be use in an immunohistochemical assay of biopsied tissue.

IX.) Identification of Molecules that Interact with 282P1G3

The 282P1G3 protein and nucleic acid sequences disclosed herein allow a skilled artisan to identify proteins, small molecules and other agents that interact with 282P1G3, as well as pathways activated by 282P1G3 via any one of a variety of art accepted protocols. For example, one can utilize one of the so-called interaction trap systems (also referred to as the "two-hybrid assay"). In such systems, molecules interact and reconstitute a transcription factor which directs expression of a reporter gene, whereupon the expression of the reporter gene is assayed. Other systems identify protein-protein interactions in vivo through reconstitution of a eukaryotic transcriptional activator, see, e.g., U.S. Pat. No. 5,955,280 issued 21 Sep. 1999, U.S. Pat. No. 5,925,523 issued 20 Jul. 1999, U.S. Pat. No. 5,846,722 issued 8 Dec. 1998 and U.S. Pat. No. 6,004,746 issued 21 Dec. 1999. Algorithms are also available in the art for genome-based predictions of protein function (see, e.g., Marcolle, et al., Nature 402: 4 Nov. 1999, 83–86).

Alternatively one can screen peptide libraries to identify molecules that interact with 282P1G3 protein sequences. In such methods, peptides that bind to 282P1G3 are identified by screening libraries that encode a random or controlled collection of amino acids. Peptides encoded by the libraries are expressed as fusion proteins of bacteriophage coat proteins, the bacteriophage particles are then screened against the 282P1G3 protein(s).

Accordingly, peptides having a wide variety of uses, such as therapeutic, prognostic or diagnostic reagents, are thus identified without any prior information on the structure of the expected ligand or receptor molecule. Typical peptide libraries and screening methods that can be used to identify molecules that interact with 282P1G3 protein sequences are disclosed for example in U.S. Pat. No. 5,723,286 issued 3 Mar. 1998 and U.S. Pat. No. 5,733,731 issued 31 Mar. 1998.

Alternatively, cell lines that express 282P1G3 are used to identify protein-protein interactions mediated by 282P1G3. Such interactions can be examined using immunoprecipitation techniques (see, e.g., Hamilton B. J., et al. Biochem. Biophys. Res. Commun. 1999, 261:646–51). 282P1G3 protein can be immunoprecipitated from 282P1G3-expressing cell lines using anti-282P1G3 antibodies. Alternatively, antibodies against His-tag can be used in a cell line engineered to express fusions of 282P1G3 and a His-tag (vectors mentioned above). The immunoprecipitated complex can be examined for protein association by procedures such as Western blotting, $^{35}$S-methionine labeling of proteins, protein microsequencing, silver staining and two-dimensional gel electrophoresis.

Small molecules and ligands that interact with 282P1G3 can be identified through related embodiments of such screening assays. For example, small molecules can be identified that interfere with protein function, including molecules that interfere with 282P1G3's ability to mediate phosphorylation and de-phosphorylation, interaction with DNA or RNA molecules as an indication of regulation of cell cycles, second messenger signaling or tumorigenesis. Similarly, small molecules that modulate 282P1G3-related ion channel, protein pump, or cell communication functions are identified and used to treat patients that have a cancer that expresses 282P1G3 (see, e.g., Hille, B., Ionic Channels of Excitable Membranes 2nd Ed., Sinauer Assoc., Sunderland, Mass., 1992). Moreover, ligands that regulate 282P1G3 function can be identified based on their ability to bind 282P1G3 and activate a reporter construct. Typical methods are discussed for example in U.S. Pat. No. 5,928,868 issued 27 Jul. 1999, and include methods for forming hybrid ligands in which at least one ligand is a small molecule. In an illustrative embodiment, cells engineered to express a fusion protein of 282P1G3 and a DNA-binding protein are used to co-express a fusion protein of a hybrid ligand/small molecule and a cDNA library transcriptional activator protein. The cells further contain a reporter gene, the expression of which is conditioned on the proximity of the first and second fusion proteins to each other, an event that occurs only if the hybrid ligand binds to target sites on both hybrid proteins. Those cells that express the reporter gene are selected and the unknown small molecule or the unknown ligand is identified. This method provides a means of identifying modulators, which activate or inhibit 282P1G3.

An embodiment of this invention comprises a method of screening for a molecule that interacts with a 282P1G3 amino acid sequence shown in FIG. 2 or FIG. 3, comprising the steps of contacting a population of molecules with a 282P1G3 amino acid sequence, allowing the population of molecules and the 282P1G3 amino acid sequence to interact under conditions that facilitate an interaction, determining the presence of a molecule that interacts with the 282P1G3 amino acid sequence, and then separating molecules that do not interact with the 282P1G3 amino acid sequence from molecules that do. In a specific embodiment, the method further comprises purifying, characterizing and identifying a molecule that interacts with the 282P1G3 amino acid sequence. The identified molecule can be used to modulate a function performed by 282P1G3. In a preferred embodiment, the 282P1G3 amino acid sequence is contacted with a library of peptides.

X.) Therapeutic Methods and Compositions

The identification of 282P1G3 as a protein that is normally expressed in a restricted set of tissues, but which is also expressed in cancers such as those listed in Table I, opens a number of therapeutic approaches to the treatment of such cancers.

Of note, targeted antitumor therapies have been useful even when the targeted protein is expressed on normal tissues, even vital normal organ tissues. A vital organ is one that is necessary to sustain life, such as the heart or colon. A non-vital organ is one that can be removed whereupon the individual is still able to survive. Examples of non-vital organs are ovary, breast, and prostate.

For example, Herceptin® is an FDA approved pharmaceutical that has as its active ingredient an antibody which is immunoreactive with the protein variously known as HER2, HER2/neu, and erb-b-2. It is marketed by Genentech and has been a commercially successful antitumor agent. Herceptin sales reached almost $400 million in 2002. Herceptin is a treatment for HER2 positive metastatic breast cancer. However, the expression of HER2 is not limited to such tumors. The same protein is expressed in a number of normal tissues. In particular, it is known that HER2/neu is present in normal kidney and heart, thus these tissues are present in all human recipients of Herceptin. The presence of HER2/neu in normal kidney is also confirmed by Latif, Z., et al., *B.J.U. International* (2002) 89:5–9. As shown in this article (which evaluated whether renal cell carcinoma should be a preferred indication for anti-HER2 antibodies such as Herceptin) both protein and mRNA are produced in benign renal tissues. Notably, HER2/neu protein was strongly overexpressed in benign renal tissue. Despite the fact that HER2/neu is expressed in such vital tissues as heart and kidney, Herceptin is a very useful, FDA approved, and commercially successful drug. The effect of Herceptin on cardiac tissue, i.e., "cardiotoxicity," has merely been a side effect to treatment. When patients were treated with Herceptin alone, significant cardiotoxicity occurred in a very low percentage of patients.

Of particular note, although kidney tissue is indicated to exhibit normal expression, possibly even higher expression than cardiac tissue, kidney has no appreciable Herceptin side effect whatsoever. Moreover, of the diverse array of normal tissues in which HER2 is expressed, there is very little occurrence of any side effect. Only cardiac tissue has manifested any appreciable side effect at all. A tissue such as kidney, where HER2/neu expression is especially notable, has not been the basis for any side effect.

Furthermore, favorable therapeutic effects have been found for antitumor therapies that target epidermal growth factor receptor (EGFR). EGFR is also expressed in numerous normal tissues. There have been very limited side effects in normal tissues following use of anti-EGFR therapeutics.

Thus, expression of a target protein in normal tissue, even vital normal tissue, does not defeat the utility of a targeting agent for the protein as a therapeutic for certain tumors in which the protein is also overexpressed.

Accordingly, therapeutic approaches that inhibit the activity of a 282P1G3 protein are useful for patients suffering from a cancer that expresses 282P1G3. These therapeutic approaches generally fall into two classes. One class comprises various methods for inhibiting the binding or association of a 282P1G3 protein with its binding partner or with other proteins. Another class comprises a variety of methods for inhibiting the transcription of a 282P1G3 gene or translation of 282P1G3 mRNA.

X.A.) Anti-Cancer Vaccines

The invention provides cancer vaccines comprising a 282P1G3-related protein or 282P1G3-related nucleic acid. In view of the expression of 282P1G3, cancer vaccines prevent and/or treat 282P1G3-expressing cancers with minimal or no effects on non-target tissues. The use of a tumor antigen in a vaccine that generates humoral and/or cell-mediated immune responses as anti-cancer therapy is well known in the art and has been employed in prostate cancer using human PSMA and rodent PAP immunogens (Hodge et al., 1995, Int. J. Cancer 63:231–237; Fong et al., 1997, J. Immunol. 159:3113–3117).

Such methods can be readily practiced by employing a 282P1G3-related protein, or a 282P1G3-encoding nucleic acid molecule and recombinant vectors capable of expressing and presenting the 282P1G3 immunogen (which typically comprises a number of antibody or T cell epitopes). Skilled artisans understand that a wide variety of vaccine systems for delivery of immunoreactive epitopes are known in the art (see, e.g., Heryln et al., Ann Med 1999 Feb. 31(1):66–78; Maruyama et al., Cancer Immunol Immunother 2000 Jun. 49(3):123–32) Briefly, such methods of generating an immune response (e.g. humoral and/or cell-mediated) in a mammal, comprise the steps of: exposing the mammal's immune system to an immunoreactive epitope (e.g. an epitope present in a 282P1G3 protein shown in FIG. 3 or analog or homolog thereof) so that the mammal generates an immune response that is specific for that epitope (e.g. generates antibodies that specifically recognize that epitope). In a preferred method, a 282P1G3 immunogen contains a biological motif, see e.g., Tables VIII–XXI and XXII–XLIX, or a peptide of a size range from 282P1G3 indicated in FIG. 5, FIG. 6, FIG. 7, FIG. 8, and FIG. 9.

The entire 282P1G3 protein, immunogenic regions or epitopes thereof can be combined and delivered by various means. Such vaccine compositions can include, for example, lipopeptides (e.g., Vitiello, A. et al., *J. Clin. Invest.* 95:341, 1995), peptide compositions encapsulated in poly(DL-lactide-co-glycolide) ("PLG") microspheres (see, e.g., Eldridge, et al., *Molec. Immunol.* 28:287–294, 1991: Alonso et al., *Vaccine* 12:299–306, 1994; Jones et al., *Vaccine* 13:675–681, 1995), peptide compositions contained in immune stimulating complexes (ISCOMS) (see, e.g., Takahashi et al., *Nature* 344:873–875, 1990; Hu et al., *Clin Exp*

*Immunol.* 113:235–243, 1998), multiple antigen peptide systems (MAPs) (see e.g., Tam, J. P., *Proc. Natl. Acad. Sci. U.S.A.* 85:5409–5413, 1988; Tam, J. P., *J. Immunol. Methods* 196:17–32, 1996), peptides formulated as multivalent peptides; peptides for use in ballistic delivery systems, typically crystallized peptides, viral delivery vectors (Perkus, M. E. et al., In: *Concepts in vaccine development*, Kaufmann, S. H. E., ed., p. 379, 1996; Chakrabarti, S. et al., *Nature* 320:535, 1986; Hu, S. L. et al., *Nature* 320:537, 1986; Kieny, M.-P. et al., *AIDS Bio/Technology* 4:790, 1986; Top, F. H. et al., *J. Infect. Dis*. 124:148, 1971; Chanda, P. K. et al., *Virology* 175:535, 1990), particles of viral or synthetic origin (e.g., Kofler, N. et al., *J. Immunol. Methods*. 192:25, 1996; Eldridge, J. H. et al., *Sem. Hematol*. 30:16, 1993; Falo, L. D., Jr. et al., *Nature Med*. 7:649, 1995), adjuvants (Warren, H. S., Vogel, F. R., and Chedid, L. A. *Annu. Rev. Immunol*. 4:369, 1986; Gupta, R. K. et a., *Vaccine* 11:293, 1993), liposomes (Reddy, R. et al., *J. Immunol*. 148:1585, 1992; Rock, K. L., *Immunol. Today* 17:131, 1996), or, naked or particle absorbed cDNA (Ulmer, J. B. et al., *Science* 259:1745, 1993; Robinson, H. L., Hunt, L. A., and Webster, R. G., *Vaccine* 11:957, 1993; Shiver, J. W. et al., In: *Concepts in vaccine development*, Kaufmann, S. H. E., ed., p. 423, 1996; Cease, K. B., and Berzofsky, J. A., *Annu. Rev. Immunol*. 12:923, 1994 and Eldridge, J. H. et al., *Sem. Hematol*. 30:16, 1993). Toxin-targeted delivery technologies, also known as receptor mediated targeting, such as those of Avant Immunotherapeutics, Inc. (Needham, Mass.) may also be used.

In patients with 282P1G3-associated cancer, the vaccine compositions of the invention can also be used in conjunction with other treatments used for cancer, e.g., surgery, chemotherapy, drug therapies, radiation therapies, etc. including use in combination with immune adjuvants such as IL-2, IL-12, GM-CSF, and the like.

Cellular Vaccines:

CTL epitopes can be determined using specific algorithms to identify peptides within 282P1G3 protein that bind corresponding HLA alleles (see e.g., Table IV; Epimer™ and Epimatrix™, Brown University, BIMAS, and SYFPEITHI. In a preferred embodiment, a 282P1G3 immunogen contains one or more amino acid sequences identified using techniques well known in the art, such as the sequences shown in Tables VIII–XXI and XXII–XLIX or a peptide of 8, 9, 10 or 11 amino acids specified by an HLA Class I motif/supennotif (e.g., Table IV (A), Table IV (D), or Table IV (E)) and/or a peptide of at least 9 amino acids that comprises an HLA Class II motif/supermotif (e.g., Table IV (B) or Table IV (C)). As is appreciated in the art, the HLA Class I binding groove is essentially closed ended so that peptides of only a particular size range can fit into the groove and be bound, generally HLA Class I epitopes are 8, 9, 10, or 11 amino acids long. In contrast, the HLA Class II binding groove is essentially open ended; therefore a peptide of about 9 or more amino acids can be bound by an HLA Class II molecule. Due to the binding groove differences between HLA Class I and II, HLA Class I motifs are length specific, i.e., position two of a Class I motif is the second amino acid in an amino to carboxyl direction of the peptide. The amino acid positions in a Class II motif are relative only to each other, not the overall peptide, i.e., additional amino acids can be attached to the amino and/or carboxyl termini of a motif-bearing sequence. HLA Class II epitopes are often 9, 10, 11, 12, 13, 14, 15, 16, 17, 18, 19, 20, 21, 22, 23, 24, or 25 amino acids long, or longer than 25 amino acids.

Antibody-based Vaccines

A wide variety of methods for generating an immune response in a mammal are known in the art (for example as the first step in the generation of hybridomas). Methods of generating an immune response in a mammal comprise exposing the mammal's immune system to an immunogenic epitope on a protein (e.g. a 282P1G3 protein) so that an immune response is generated. A typical embodiment consists of a method for generating an immune response to 282P1G3 in a host, by contacting the host with a sufficient amount of at least one 282P1G3 B cell or cytotoxic T-cell epitope or analog thereof; and at least one periodic interval thereafter re-contacting the host with the 282P1G3 B cell or cytotoxic T-cell epitope or analog thereof. A specific embodiment consists of a method of generating an immune response against a 282P1G3-related protein or a man-made multiepitopic peptide comprising: administering 282P1G3 immunogen (e.g. a 282P1G3 protein or a peptide fragment thereof, a 282P1G3 fusion protein or analog etc.) in a vaccine preparation to a human or another mammal. Typically, such vaccine preparations further contain a suitable adjuvant (see, e.g., U.S. Pat. No. 6,146,635) or a universal helper epitope such as a PADRE™ peptide (Epimmune Inc., San Diego, Calif.; see, e.g., Alexander et al., J. Immunol. 2000 164(3); 164(3): 1625–1633; Alexander et al., Immunity 1994 1(9): 751–761 and Alexander et al., Immunol. Res. 1998 18(2): 79–92). An alternative method comprises generating an immune response in an individual against a 282P1G3 immunogen by: administering in vivo to muscle or skin of the individual's body a DNA molecule that comprises a DNA sequence that encodes a 282P1G3 immunogen, the DNA sequence operatively linked to regulatory sequences which control the expression of the DNA sequence; wherein the DNA molecule is taken up by cells, the DNA sequence is expressed in the cells and an immune response is generated against the immunogen (see, e.g., U.S. Pat. No. 5,962,428). Optionally a genetic vaccine facilitator such as anionic lipids; saponins; lectins; estrogenic compounds; hydroxylated lower alkyls; dimethyl sulfoxide; and urea is also administered. In addition, an antiidiotypic antibody can be administered that mimics 282P1G3, in order to generate a response to the target antigen.

Nucleic Acid Vaccines:

Vaccine compositions of the invention include nucleic acid-mediated modalities. DNA or RNA that encode protein(s) of the invention can be administered to a patient. Genetic immunization methods can be employed to generate prophylactic or therapeutic humoral and cellular immune responses directed against cancer cells expressing 282P1G3. Constructs comprising DNA encoding a 282P1G3-related protein/immunogen and appropriate regulatory sequences can be injected directly into muscle or skin of an individual, such that the cells of the muscle or skin take-up the construct and express the encoded 282P1G3 protein/immunogen. Alternatively, a vaccine comprises a 282P1G3-related protein. Expression of the 282P1G3-related protein immunogen results in the generation of prophylactic or therapeutic humoral and cellular immunity against cells that bear a 282P1G3 protein. Various prophylactic and therapeutic genetic immunization techniques known in the art can be used (for review, see information and references published at Internet address genweb.com). Nucleic acid-based delivery is described, for instance, in Wolff et. al., *Science* 247:1465 (1990) as well as U.S. Pat. Nos. 5,580,859; 5,589,466; 5,804,566; 5,739,118; 5,736,524; 5,679,647; WO 98/04720. Examples of DNA-based delivery technologies include "naked DNA", facilitated (bupivicaine, polymers, peptide-mediated) delivery, cationic lipid complexes, and particle-mediated ("gene gun") or pressure-mediated delivery (see, e.g., U.S. Pat. No. 5,922,687).

For therapeutic or prophylactic immunization purposes, proteins of the invention can be expressed via viral or bacterial vectors. Various viral gene delivery systems that can be used in the practice of the invention include, but are not limited to, vaccinia, fowlpox, canarypox, adenovirus, influenza, poliovirus, adeno-associated virus, lentvirus, and sindbis virus (see, e.g., Restifo, 1996, Curr. Opin. Immunol. 8:658–663; Tsang et al., *J. Natl. Cancer Inst* 87:982–990 (1995)). Non-viral delivery systems can also be employed by introducing naked DNA encoding a 282P1G3-related protein into the patient (e.g., intramuscularly or intradermally) to induce an ant-tumor response.

Vaccinia virus is used, for example, as a vector to express nucleotide sequences that encode the peptides of the invention. Upon introduction into a host, the recombinant vaccinia virus expresses the protein immunogenic peptide, and thereby elicits a host immune response. Vaccinia vectors and methods useful in immunization protocols are described in, e.g., U.S. Pat. No. 4,722,848. Another vector is BCG (Bacille Calmette Guerin). BCG vectors are described in Stover et al., *Nature* 351:456–460 (1991). A wide variety of other vectors useful for therapeutic administration or immunization of the peptides of the invention, e.g. adeno and adeno-associated virus vectors, retroviral vectors, *Salmonella typhi* vectors, detoxified anthrax toxin vectors, and the like, will be apparent to those skilled in the art from the description herein.

Thus, gene delivery systems are used to deliver a 282P1G3-related nucleic acid molecule. In one embodiment, the full-length human 282P1G3 cDNA is employed. In another embodiment, 282P1G3 nucleic acid molecules encoding specific cytotoxic T lymphocyte (CTL) and/or antibody epitopes are employed.

Ex Vivo Vaccines

Various ex vivo strategies can also be employed to generate an immune response. One approach involves the use of antigen presenting cells (APCs) such as dendrinc cells (DC) to present 282P1G3 antgen to a patient's immune system. Dendritic cells express MHC class I and II molecules, B7 co-stimulator, and IL-1 2, and are thus highly specialized antigen presenting cells. In prostate cancer, autologous dendritic cells pulsed with peptides of the prostate-specific membrane antigen (PSMA) are being used in a Phase I clinical trial to stimulate prostate cancer patients' immune systems (Tjoa et al., 1996, Prostate 28:65–69; Murphy et al., 1996, Prostate 29:371–380). Thus, dendritic cells can be used to present 282P1G3 peptides to T cells in the context of MHC class I or II molecules. In one embodiment, autologous dendritic cells are pulsed with 282P1G3 peptides capable of binding to MHC class I and/or class II molecules. In another embodiment, dendritic cells are pulsed with the complete 282P1G3 protein. Yet another embodiment involves engineering the overexpression of a 282P1G3 gene in dendritic cells using various implementing vectors known in the art, such as adenovirus (Arthur et al., 1997, Cancer Gene Ther. 4:17–25), retrovirus (Henderson et al., 1996, Cancer Res. 56:3763–3770), lentivirus, adeno-associated virus, DNA transfection (Ribas et al., 1997, Cancer Res. 57:2865–2869), or tumor-derived RNA transfection (Ashley et al., 1997, J. Exp. Med. 186:1177–1182). Cells that express 282P1G3 can also be engineered to express immune modulators, such as GM-CSF, and used as immunizing agents.

X.B.) 282P1G3 as a Target for Antibody-based Therapy

282P1G3 is an attractive target for antibody-based therapeutic strategies. A number of antibody strategies are known in the art for targeting both extracellular and intracellular molecules (see, e.g., complement and ADCC mediated killing as well as the use of intrabodies). Because 282P1G3 is expressed by cancer cells of various lineages relative to corresponding normal cells, systemic administration of 282P1G3-immunoreactive compositions are prepared that exhibit excellent sensitivity without toxic, non-specific and/or non-target effects caused by binding of the immunoreactive composition to non-target organs and tissues. Antibodies specifically reactive with domains of 282P1G3 are useful to treat 282P1G3-expressing cancers systemically, either as conjugates with a toxin or therapeutic agent, or as naked antibodies capable of inhibiting cell proliferation or function.

282P1G3 antibodies can be introduced into a patient such that the antibody binds to 282P1G3 and modulates a function, such as an interaction with a binding partner, and consequently mediates destruction of the tumor cells and/or inhibits the growth of the tumor cells. Mechanisms by which such antibodies exert a therapeutic effect can include complement-mediated cytolysis, antibody-dependent cellular cytotoxicity, modulation of the physiological function of 282P1G3, inhibition of ligand binding or signal transduction pathways, modulation of tumor cell differentiation, alteration of tumor angiogenesis factor profiles, and/or apoptosis.

Those skilled in the art understand that antibodies can be used to specifically target and bind immunogenic molecules such as an immunogenic region of a 282P1G3 sequence shown in FIG. 2 or FIG. 3. In addition, skilled artisans understand that it is routine to conjugate antibodies to cytotoxic agents (see, e.g., Slevers et al. *Blood* 93:11 3678–3684 (Jun. 1, 1999)). When cytotoxic and/or therapeutic agents are delivered directly to cells, such as by conjugating them to antibodies specific for a molecule expressed by that cell (e.g. 282P1G3), the cytotoxic agent will exert its known biological effect (i.e. cytotoxicity) on those cells.

A wide variety of compositions and methods for using antibody-cytotoxic agent conjugates to kill cells are known in the art. In the context of cancers, typical methods entail administering to an animal having a tumor a biologically effective amount of a conjugate comprising a selected cytotoxic and/or therapeutic agent linked to a targeting agent (e.g. an anti-282P1G3 antibody) that binds to a marker (e.g. 282P1G3) expressed, accessible to binding or localized on the cell surfaces. A typical embodiment is a method of delivering a cytotoxic and/or therapeutic agent to a cell expressing 282P1G3, comprising conjugating the cytotoxic agent to an antibody that immunospecifically binds to a 282P1G3 epitope, and, exposing the cell to the antibody-agent conjugate. Another illustrative embodiment is a method of treating an individual suspected of suffering from metastasized cancer, comprising a step of administering parenterally to said individual a pharmaceutical composition comprising a therapeutically effective amount of an antibody conjugated to a cytotoxic and/or therapeutic agent.

Cancer immunotherapy using anti-282P1G3 antibodies can be done in accordance with various approaches that have been successfully employed in the treatment of other types of cancer, including but not limited to colon cancer (Arlen et al., 1998, Crit. Rev. Immunol. 18:133–138), multiple myeloma (Ozaki et al., 1997, Blood 90:3179–3186, Tsunenari et al., 1997, Blood 90:2437–2444), gastric cancer (Kasprzyk et al., 1992, Cancer Res. 52:2771–2776), B-cell lymphoma (Funakoshi et al., 1996, J. Immunother. Emphasis Tumor Immunol. 19:93–101), leukemia (Zhong et al., 1996, Leuk. Res. 20:581–589), colorectal cancer (Moun et al., 1994, Cancer Res. 54:6160–6166; Velders et al., 1995, Cancer Res. 55:4398–4403), and breast cancer (Shepard et al., 1991, J. Clin. Immunol. 11:117–127). Some therapeutic approaches involve conjugation of naked antibody to a toxin or radioisotope, such as the conjugation of $Y^{91}$ or $I^{131}$ to anti-CD20 antibodies (e.g., Zevalin™, IDEC Pharmaceuticals Corp. or Bexxar™, Coulter Pharmaceuticals), while others involve co-administration of antibodies and other therapeutic agents, such as Herceptin™ (trastuzumab) with paclitaxel (Genentech, Inc.). The antibodies can be conjugated to a therapeutic agent. To treat prostate cancer, for example, 282P1G3 antibodies can be administered in conjunction with radiation, chemotherapy or hormone ablation. Also, antibodies can be conjugated to a toxin such as calicheamicin (e.g., Mylotarg™, Wyeth-Ayerst, Madison, N.J., a recombinant humanized $IgG_4$ kappa antibody conjugated to antitumor antibiotic calicheamicin) or a maytansinoid (e.g., taxane-based Tumor-Activated Prodrug, TAP, platform, ImmunoGen, Cambridge, Mass., also see e.g., U.S. Pat. No. 5,416,064).

Although 282P1G3 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well. Fan et al. (Cancer Res. 53:4637–4642, 1993), Prewett et al. (International J. of Onco. 9:217–224, 1996), and Hancock et al. (Cancer Res. 51:4575–4580, 1991) describe the use of various antibodies together with chemotherapeutic agents.

Although 282P1G3 antibody therapy is useful for all stages of cancer, antibody therapy can be particularly appropriate in advanced or metastatic cancers. Treatment with the antibody therapy of the invention is indicated for patients who have received one or more rounds of chemotherapy. Alternatively, antibody therapy of the invention is combined with a chemotherapeutic or radiation regimen for patients who have not received chemotherapeutic treatment. Additionally, antibody therapy can enable the use of reduced dosages of concomitant chemotherapy, particularly for patients who do not tolerate the toxicity of the chemotherapeutic agent very well.

Cancer patients can be evaluated for the presence and level of 282P1G3 expression, preferably using immunohistochemical assessments of tumor tissue, quantitative 282P1G3 imaging, or other techniques that reliably indicate the presence and degree of 282P1G3 expression. Immunohistochemical analysis of tumor biopsies or surgical specimens is preferred for this purpose. Methods for immunohistochemical analysis of tumor tissues are well known in the art.

Anti-282P1G3 monoclonal antibodies that treat prostate and other cancers include those that initiate a potent immune response against the tumor or those that are directly cytotoxic. In this regard, anti-282P1G3 monoclonal antibodies (mAbs) can elicit tumor cell lysis by either complement-mediated or antibody-dependent cell cytotoxicity (ADCC) mechanisms, both of which require an intact Fc portion of the immunoglobulin molecule for interaction with effector cell Fc receptor sites on complement proteins. In addition, anti-282P1G3 mAbs that exert a direct biological effect on tumor growth are useful to treat cancers that express 282P1G3. Mechanisms by which directly cytotoxic mAbs act include: inhibition of cell growth, modulation of cellular differentiation, modulation of tumor angiogenesis factor profiles, and the induction of apoptosis. The mechanism(s) by which a particular anti-282P1G3 mAb exerts an anti-tumor effect is evaluated using any number of in vitro assays that evaluate cell death such as ADCC, ADMMC, complement-mediated cell lysis, and so forth, as is generally known in the art.

In some patients, the use of murine or other non-human monoclonal antibodies, or human/mouse chimeric mAbs can induce moderate to strong immune responses against the non-human antibody. This can result in clearance of the antibody from circulation and reduced efficacy. In the most severe cases, such an immune response can lead to the extensive formation of immune complexes which, potentially, can cause renal failure. Accordingly, preferred monoclonal antibodies used in the therapeutic methods of the invention are those that are either fully human or humanized and that bind specifically to the target 282P1G3 antigen with high affinity but exhibit low or no antigenicity in the patient.

Therapeutic methods of the invention contemplate the administration of single anti-282P1G3 mAbs as well as combinations, or cocktails, of different mAbs. Such mAb cocktails can have certain advantages inasmuch as they contain mAbs that target different epitopes, exploit different effector mechanisms or combine directly cytotoxic mAbs with mAbs that rely on immune effector functionality. Such mAbs in combination can exhibit synergistic therapeutic effects. In addition, anti-282P1G3 mAbs can be administered concomitantly with other therapeutic modalities, including but not limited to various chemotherapeutic agents, androgen-blockers, immune modulators (e.g., IL-2, GM-CSF), surgery or radiation. The anti-282P1G3 mAbs are administered in their "naked" or unconjugated form, or can have a therapeutic agent(s) conjugated to them.

Anti-282P1G3 antibody formulations are administered via any route capable of delivering the antibodies to a tumor cell. Routes of administration include, but are not limited to, intravenous, intraperitoneal, intramuscular, intratumor, intradermal, and the like. Treatment generally involves repeated administration of the anti-282P1G3 antibody preparation, via an acceptable route of administration such as intravenous injection (IV), typically at a dose in the range of about 0.1, 0.2, 0.3, 0.4, 0.5, 0.6, 0.7, 0.8, 0.9, 1, 2, 3, 4, 5, 6, 7, 8, 9, 10, 15, 20, or 25 mg/kg body weight. In general, doses in the range of 10–1000 mg mAb per week are effective and well tolerated.

Based on clinical experience with the Herceptin™ mAb in the treatment of metastatic breast cancer, an initial loading dose of approximately 4 mg/kg patient body weight IV, followed by weekly doses of about 2 mg/kg IV of the anti-282P1G3 mAb preparation represents an acceptable dosing regimen. Preferably, the initial loading dose is administered as a 90-minute or longer infusion. The periodic maintenance dose is administered as a 30 minute or longer infusion, provided the initial dose was well tolerated. As appreciated by those of skill in the art, various factors can influence the ideal dose regimen in a particular case. Such factors include, for example, the binding affinity and half life of the Ab or mAbs used, the degree of 282P1G3 expression in the patient, the extent of circulating shed 282P1G3 antigen, the desired steady-state antibody concentration level, frequency of treatment, and the influence of chemotherapeutic or other agents used in combination with the treatment method of the invention, as well as the health status of a particular patient.

Optionally, patients should be evaluated for the levels of 282P1G3 in a given sample (e.g. the levels of circulating 282P1G3 antigen and/or 282P1G3 expressing cells) in order to assist in the determination of the most effect dosing regimen, etc. Such evaluations are also used for monitoring purposes throughout therapy, and are useful to gauge therapeutic success in combination with the evaluation of other parameters (for example, urine cytology and/or ImmunoCyt levels in bladder cancer therapy, or by analogy, serum PSA levels in prostate cancer therapy).

Anti-idiotypic anti-282P1G3 antibodies can also be used in anti-cancer therapy as a vaccine for inducing an immune response to cells expressing a 282P1G3-related protein. In particular, the generation of anti-idiotypic antibodies is well known in the art; this methodology can readily be adapted to generate anti-idiotypic anti-282P1G3 antibodies that mimic an epitope on a 282P1G3-related protein (see, for example, Wagner et al., 1997, Hybridoma 16: 33–40; Foon et al., 1995, J. Clin. Invest. 96:334–342; Herlyn et al., 1996, Cancer Immunol. Immunother. 43:65–76). Such an anti-idiotypic antibody can be used in cancer vaccine strategies.

X.C.) 282P1G3 as a Target for Cellular Immune Responses

Vaccines and methods of preparing vaccines that contain an immunogenically effective amount of one or more HLA-binding peptides as described herein are further embodiments of the invention. Furthermore, vaccines in accordance with the invention encompass compositions of one or more of the claimed peptides. A peptide can be present in a vaccine individually. Alternatively, the peptide can exist as a homopolymer comprising multiple copies of the same peptide, or as a heteropolymer of various peptides. Polymers have the advantage of increased immunological reaction and, where different peptide epitopes are used to make up the polymer, the additional ability to induce antibodies and/or CTLs that react with different antigenic determinants of the pathogenic organism or tumor-related peptide targeted for an immune response. The composition can be a naturally occurring region of an antigen or can be prepared, e.g., recombinantly or by chemical synthesis.

Carriers that can be used with vaccines of the invention are well known in the art, and include, e.g., thyroglobulin, albumins such as human serum albumin, tetanus toxoid, polyamino acids such as poly L-lysine, poly L-glutamic acid, influenza, hepatitis B virus core protein, and the like. The vaccines can contain a physiologically tolerable (i.e., acceptable) diluent such as water, or saline, preferably phosphate buffered saline. The vaccines also typically include an adjuvant. Adjuvants such as incomplete Freund's adjuvant, aluminum phosphate, aluminum hydroxide, or alum are examples of materials well known in the art. Additionally, as disclosed herein, CTL responses can be primed by conjugating peptides of the invention to lipids, such as tripalmitoyl-S-glycerylcysteinlyseryl- serine ($P_3CSS$). Moreover, an adjuvant such as a synthetic cytosine-phosphorothiolated-guanine-containing (CpG) oligonucleotides has been found to increase CTL responses 10- to 100-fold. (see, e.g. Davila and Celis, J. Immunol. 165: 539–547 (2000))

Upon immunization with a peptide composition in accordance with the invention, via injection, aerosol, oral, transdermal, transmucosal, intrapleural, intrathecal, or other suitable routes, the immune system of the host responds to the vaccine by producing large amounts of CTLs and/or HTLs specific for the desired antigen. Consequently, the host becomes at least partially immune to later development of cells that express or overexpress 282P1G3 antigen, or derives at least some therapeutic benefit when the antigen was tumor-associated.

In some embodiments, it may be desirable to combine the class I peptide components with components that induce or facilitate neutralizing antibody and or helper T cell responses directed to the target antigen. A preferred embodiment of such a composition comprises class I and class II epitopes in accordance with the invention. An alternative embodiment of such a composition comprises a class I and/or class II epitope in accordance with the invention, along with a cross reactive HTL epitope such as PADRE™ (Epimmune, San Diego, Calif.) molecule (described e.g., in U.S. Pat. No. 5,736,142).

A vaccine of the invention can also include antigen-presenting cells (APC), such as dendritic cells (DC), as a vehicle to present peptides of the invention. Vaccine compositions can be created in vitro, following dendritic cell mobilization and harvesting, whereby loading of dendritic cells occurs in vitro. For example, dendritic cells are transfected, e.g., with a minigene in accordance with the invention, or are pulsed with pepfides. The dendritic cell can then be administered to a patient to elicit immune responses in vivo. Vaccine compositions, either DNA- or peptide-based, can also be administered in vivo in combination with dendritic cell mobilization whereby loading of dendritic cells occurs in vivo.

Preferably, the following principles are utilized when selecting an array of epitopes for inclusion in a polyepitopic composition for use in a vaccine, or for selecting discrete epitopes to be included in a vaccine and/or to be encoded by nucleic acids such as a minigene. It is preferred that each of the following principles be balanced in order to make the selection. The multiple epitopes to be incorporated in a given vaccine composition may be, but need not be, contiguous in sequence in the native antigen from which the epitopes are derived.

1.) Epitopes are selected which, upon administration, mimic immune responses that have been observed to be correlated with tumor clearance. For HLA Class I this includes 3–4 epitopes that come from at least one tumor associated antigen (TAA). For HLA Class II a similar rationale is employed; again 3–4 epitopes are selected from at least one TAA (see, e.g., Rosenberg et al., *Science* 278:1447–1450). Epitopes from one TAA may be used in combination with epitopes from one or more additional TAAs to produce a vaccine that targets tumors with varying expression patterns of frequently-expressed TAAs.

2.) Epitopes are selected that have the requisite binding affinity established to be correlated with immunogenicity: for HLA Class I an $IC_{50}$ of 500 nM or less, often 200 nM or less; and for Class II an $IC_{50}$ of 1000 nM or less.

3.) Sufficient supermotif bearing-peptides, or a sufficient array of allele-specific motif-bearing pepfides, are selected to give broad population coverage. For example, it is preferable to have at least 80% population coverage. A Monte Carlo analysis, a statistical evaluation known in the art, can be employed to assess the breadth, or redundancy of, population coverage.

4.) When selecting epitopes from cancer-related antigens it is often useful to select analogs because the patient may have developed tolerance to the native epitope.

5.) Of particular relevance are epitopes referred to as "nested epitopes." Nested epitopes occur where at least two epitopes overlap in a given peptide sequence. A nested peptide sequence can comprise B cell, HLA class I and/or HLA class II epitopes. When providing nested epitopes, a general objective is to provide the greatest number of epitopes per sequence. Thus, an aspect is to avoid providing a peptide that is any longer than the amino terminus of the amino terminal epitope and the carboxyl terminus of the carboxyl terminal epitope in the peptide. When providing a multi-epitopic sequence, such as a sequence comprising nested epitopes, it is generally important to screen the sequence in order to insure that it does not have pathological or other deleterious biological properties.

6.) If a polyepitopic protein is created, or when creating a minigene, an objective is to generate the smallest peptide that encompasses the epitopes of interest. This principle is similar, if not the same as that employed when selecting a peptide comprising nested epitopes. However, with an artificial polyepitopic peptide, the size minimization objective is balanced against the need to integrate any spacer sequences between epitopes in the polyepitopic protein. Spacer amino acid residues can, for example, be introduced to avoid junctional epitopes (an epitope recognized by the immune system, not present in the target antigen, and only created by the man-made juxtaposition of epitopes), or to facilitate cleavage between epitopes and thereby enhance epitope presentation. Junctional epitopes are generally to be avoided because the recipient may generate an immune response to that non-native epitope. Of particular concern is a junctional epitope that is a "dominant epitope". A dominant epitope may lead to such a zealous response that immune responses to other epitopes are diminished or suppressed.

7.) Where the sequences of multiple variants of the same target protein are present, potential peptide epitopes can also be selected on the basis of their conservancy. For example, a criterion for conservancy may define that the entire sequence of an HLA class I binding peptide or the entire 9-mer core of a class II binding peptide be conserved in a designated percentage of the sequences evaluated for a specific protein antigen.

X.C.1. Minigene Vaccines

A number of different approaches are available which allow simultaneous delivery of multiple epitopes. Nucleic acids encoding the peptides of the invention are a particularly useful embodiment of the invention. Epitopes for inclusion in a minigene are preferably selected according to the guidelines set forth in the previous section. A preferred means of administering nucleic acids encoding the peptides of the invention uses minigene constructs encoding a peptide comprising one or multiple epitopes of the invention.

The use of multi-epitope minigenes is described below and in, Ishioka et al., *J. Immunol.* 162:3915–3925, 1999; An, L. and Whitton, J. L., *J. Virol.* 71:2292, 1997; Thomson, S. A. et al., *J. Immunol.* 157:822, 1996; Whitton, J. L. et al., *J. Virol.* 67:348, 1993; Hanke, R. et al., *Vaccine* 16:426, 1998. For example, a multi-epitope DNA plasmid encoding supermotif-and/or motif-bearing epitopes derived 282P1G3, the PADRE® universal helper T cell epitope or multiple HTL epitopes from 282P1G3 (see e.g., Tables VIII–XXI and XXII to XLIX), and an endoplasmic reticulum-translocating signal sequence can be engineered. A vaccine may also comprise epitopes that are derived from other TAAs.

The immunogenicity of a multi-epitopic minigene can be confirmed in transgenic mice to evaluate the magnitude of CTL induction responses against the epitopes tested. Further, the immunogenicity of DNA-encoded epitopes in vivo can be correlated with the in vitro responses of specific CTL lines against target cells transfected with the DNA plasmid. Thus, these experiments can show that the minigene serves to both: 1.) generate a CTL response and 2.) that the induced CTLs recognized cells expressing the encoded epitopes.

For example, to create a DNA sequence encoding the selected epitopes (minigene) for expression in human cells, the amino acid sequences of the epitopes may be reverse translated. A human codon usage table can be used to guide the codon choice for each amino acid. These epitope-encoding DNA sequences may be directly adjoined, so that when translated, a continuous polypeptide sequence is created. To optimize expression and/or immunogenicity, additional elements can be incorporated into the minigene design. Examples of amino acid sequences that can be reverse translated and included in the minigene sequence include: HLA class I epitopes, HLA class II epitopes, antibody epitopes, a ubiquitination signal sequence, and/or an endoplasmic reticulum targeting signal. In addition, HLA presentation of CTL and HTL epitopes may be improved by including synthetic (e.g. poly-alanine) or naturally-occurring flanking sequences adjacent to the CTL or HTL epitopes; these larger peptides comprising the epitope(s) are within the scope of the invention.

The minigene sequence may be converted to DNA by assembling oligonucleotides that encode the plus and minus strands of the minigene. Overlapping oligonucleotides (30–100 bases long) may be synthesized, phosphorylated, purified and annealed under appropriate conditions using well known techniques. The ends of the oligonucleotides can be joined, for example, using T4 DNA ligase. This synthetic minigene, encoding the epitope polypeptide, can then be cloned into a desired expression vector.

Standard regulatory sequences well known to those of skill in the art are preferably included in the vector to ensure expression in the target cells. Several vector elements are desirable: a promoter with a down-stream cloning site for minigene insertion; a polyadenylation signal for efficient transcription termination; an *E. coli* origin of replication; and an *E. coli* selectable marker (e.g. ampicillin or kanamycin resistance). Numerous promoters can be used for this purpose, e.g., the human cytomegalovirus (hCMV) promoter. See, e.g., U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences and sequences for replication in mammalian cells may also be considered for increasing minigene expression.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

In addition, immunostimulatory sequences (ISSs or CpGs) appear to play a role in the immunogenicity of DNA vaccines. These sequences may be included in the vector, outside the minigene coding sequence, if desired to enhance immunogenicity.

In some embodiments, a bi-cistronic expression vector which allows production of both the minigene-encoded epitopes and a second protein (included to enhance or decrease immunogenicity) can be used. Examples of proteins or polypeptides that could beneficially enhance the immune response if co-expressed include cytokines (e.g., IL-2, IL-12, GM-CSF), cytokine-inducing molecules (e.g., LeIF), costimulatory molecules, or for HTL responses, pan-DR binding proteins (PADRE™, Epimmune, San Diego, Calif.). Helper (HTL) epitopes can be joined to intracellular targeting signals and expressed separately from expressed CTL epitopes; this allows direction of the HTL epitopes to a cell compartment different than that of the CTL epitopes. If required, this could facilitate more efficient entry of HTL epitopes into the HLA class II pathway, thereby improving HTL induction. In contrast to HTL or CTL induction, specifically decreasing the immune response by co-expression of immunosuppressive molecules (e.g. TGF-β) may be beneficial in certain diseases.

Therapeutic quantities of plasmid DNA can be produced for example, by fermentation in *E. coli*, followed by purification. Aliquots from the working cell bank are used to inoculate growth medium, and grown to saturation in shaker flasks or a bioreactor according to well-known techniques. Plasmid DNA can be purified using standard bioseparation technologies such as solid phase anion-exchange resins supplied by QIAGEN, Inc. (Valencia, Calif.). If required, supercoiled DNA can be isolated from the open circular and linear forms using gel electrophoresis or other methods.

Purified plasmid DNA can be prepared for injection using a variety of formulations. The simplest of these is reconstitution of lyophilized DNA in sterile phosphate-buffer saline (PBS). This approach, known as “naked DNA,” is currently being used for intramuscular (IM) administration in clinical trials. To maximize the immunotherapeutic effects of minigene DNA vaccines, an alternative method for formulating purified plasmid DNA may be desirable. A variety of methods have been described, and new techniques may become available. Cationic lipids, glycolipids, and fusogenic liposomes can also be used in the formulation (see, e.g., as described by WO 93/24640; Mannino & Gould-Fogerite, *Bio Techniques* 6(7): 682 (1988); U.S. Pat. No. 5,279,833; WO 91/06309; and Felgner, et al., *Proc. Nat'l Acad. Sci. USA* 84:7413 (1987). In addition, peptides and compounds referred to collectively as protective, interactive, non-condensing compounds (PINC) could also be complexed to purified plasmid DNA to influence variables such as stability, intramuscular dispersion, or trafficking to specific organs or cell types.

Target cell sensitization can be used as a functional assay for expression and HLA class I presentation of minigene-encoded CTL epitopes. For example, the plasmid DNA is introduced into a mammalian cell line that is suitable as a target for standard CTL chromium release assays. The transfection method used will be dependent on the final formulation. Electroporation can be used for “naked” DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 ($^{51}$Cr) labeled and used as target cells for epitope-specific CTL lines; cytolysis, detected by $^{51}$Cr release, indicates both production of, and HLA presentation of, minigene-encoded CTL epitopes. Expression of HTL epitopes may be evaluated in an analogous manner using assays to assess HTL activity.

In vivo immunogenicity is a second approach for functional testing of minigene DNA formulations. Transgenic mice expressing appropriate human HLA proteins are immunized with the DNA product. The dose and route of administration are formulation dependent (e.g., IM for DNA in PBS, intraperitoneal (i.p.) for lipid-complexed DNA). Twenty-one days after immunization, splenocytes are harvested and restimulated for one week in the presence of peptides encoding each epitope being tested. Thereafter, for CTL effector cells, assays are conducted for cytolysis of peptide-loaded, $^{51}$Cr-labeled target cells using standard techniques. Lysis of target cells that were sensitized by HLA loaded with peptide epitopes, corresponding to minigene-encoded epitopes, demonstrates DNA vaccine function for in vivo induction of CTLs. Immunogenicity of HTL epitopes is confirmed in transgenic mice in an analogous manner.

Alternatively, the nucleic acids can be administered using ballistic delivery as described, for instance, in U.S. Pat. No. 5,204,253. Using this technique, particles comprised solely of DNA are administered. In a further alternative embodiment, DNA can be adhered to particles, such as gold particles.

Minigenes can also be delivered using other bacterial or viral delivery systems well known in the art, e.g., an expression construct encoding epitopes of the invention can be incorporated into a viral vector such as vaccinia.

X.C.2. Combinations of CTL Peptides with Helper Peptides

Vaccine compositions comprising CTL peptides of the invention can be modified, e.g., analoged, to provide desired attributes, such as improved serum half life, broadened population coverage or enhanced immunogenicity.

For instance, the ability of a peptide to induce CTL activity can be enhanced by linking the peptide to a sequence which contains at least one epitope that is capable of inducing a T helper cell response. Although a CTL peptide can be directly linked to a T helper peptide, often CTL epitope/HTL epitope conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues and sometimes 10 or more residues. The CTL peptide epitope can be linked to the T helper peptide epitope either directly or via a spacer either at the amino or carboxy terminus of the CTL peptide. The amino terminus of either the immunogenic peptide or the T helper peptide may be acylated.

In certain embodiments, the T helper peptide is one that is recognized by T helper cells present in a majority of a genetically diverse population. This can be accomplished by selecting peptides that bind to many, most, or all of the HLA class II molecules. Examples of such amino acid bind many HLA Class II molecules include sequences from antigens such as tetanus toxoid at positions 830–843 (QYIKANSKFIGITE; SEQ ID NO: 37), *Plasmodium falciparum* circumsporozoite (CS) protein at positions 378–398 (DIEKKIAKMEKASSVFNVVNS; SEQ ID NO: 38), and *Streptococcus* 18 kD protein at positions 116–131 (GAVDSILGGVATYGAA; SEQ ID NO: 39). Other examples include peptides bearing a DR 1-4-7 supermotif, or either of the DR3 motifs.

Alternatively, it is possible to prepare synthetic peptides capable of stimulating T helper lymphocytes, in a loosely HLA-restricted fashion, using amino acid sequences not found in nature (see, e.g., PCT publication WO 95/07707). These synthetic compounds called Pan-DR-binding epitopes (e.g., PADRE™, Epimmune, Inc., San Diego, Calif.) are designed, most preferably, to bind most HLA-DR (human HLA class II) molecules. For instance, a pan-DR-binding epitope peptide having the formula: aKXVAAWTLKAa (SEQ ID NO: 40), where "X" is either cyclohexylalanine, phenylalanine, or tyrosine, and a is either D-alanine or L-alanine, has been found to bind to most HLA-DR alleles, and to stimulate the response of T helper lymphocytes from most individuals, regardless of their HLA type. An alternative of a pan-DR binding epitope comprises all "L" natural amino acids and can be provided in the form of nucleic acids that encode the epitope.

HTL peptide epitopes can also be modified to alter their biological properties. For example, they can be modified to include D-amino acids to increase their resistance to proteases and thus extend their serum half life, or they can be conjugated to other molecules such as lipids, proteins, carbohydrates, and the like to increase their biological activity. For example, a T helper peptide can be conjugated to one or more palmitic acid chains at either the amino or carboxyl termini.

X.C.3. Combinations of CTL Peptides with T Cell Priming Agents

In some embodiments it may be desirable to include in the pharmaceutical compositions of the invention at least one component which primes B lymphocytes or T lymphocytes. Lipids have been identified as agents capable of priming CTL in vivo. For example, palmitic acid residues can be attached to the ϵ- and α-amino groups of a lysine residue and then linked, e.g., via one or more linking residues such as Gly, Gly-Gly-, Ser, Ser-Ser, or the like, to an immunogenic peptide. The lipidated peptide can then be administered either directly in a micelle or particle, incorporated into a liposome, or emulsified in an adjuvant, e.g., incomplete Freund's adjuvant. In a preferred embodiment, a particularly effective immunogenic composition comprises palmitic acid attached to the ϵ- and α-amino groups of Lys, which is attached via linkage, e.g., Ser-Ser, to the amino terminus of the immunogenic peptide.

As another example of lipid priming of CTL responses, *E. coli* lipoproteins, such as tripalmitoyl-S-glycerylcysteinlyseryl-serine ($P_3CSS$) can be used to prime virus specific CTL when covalently attached to an appropriate peptide (see, e.g., Deres, et al., *Nature* 342:561, 1989). Peptides of the invention can be coupled to $P_3CSS$, for example, and the lipopeptide administered to an individual to prime specifically an immune response to the target antigen. Moreover, because the induction of neutralizing antibodies can also be primed with $P_3CSS$-conjugated epitopes, two such compositions can be combined to more effectively elicit both humoral and cell-mediated responses.

X.C.4. Vaccine Compositions Comprising DC Pulsed with CTL and/or HTL Peptides

An embodiment of a vaccine composition in accordance with the invention comprises ex vivo administration of a cocktail of epitope-bearing peptides to PBMC, or isolated DC therefrom, from the patient's blood. A pharmaceutical to facilitate harvesting of DC can be used, such as Progenipoietin™ (Pharmacia-Monsanto, St. Louis, Mo.) or GM-CSF/IL-4. After pulsing the DC with peptides and prior to reinfusion into patients, the DC are washed to remove unbound peptides. In this embodiment, a vaccine comprises peptide-pulsed DCs which present the pulsed peptide epitopes complexed with HLA molecules on their surfaces.

The DC can be pulsed ex vivo with a cocktail of peptides, some of which stimulate CTL responses to 282P1G3. Optionally, a helper T cell (HTL) peptide, such as a natural or artificial loosely restricted HLA Class II peptide, can be included to facilitate the CTL response. Thus, a vaccine in accordance with the invention is used to treat a cancer which expresses or overexpresses 282P1G3.

X.D. Adoptive Immunotherapy

Antigenic 282P1G3-related peptides are used to elicit a CTL and/or HTL response ex vivo, as well. The resulting CTL or HTL cells, can be used to treat tumors in patients that do not respond to other conventional forms of therapy, or will not respond to a therapeutic vaccine peptide or nucleic acid in accordance with the invention. Ex vivo CTL or HTL responses to a particular antigen are induced by incubating in tissue culture the patient's, or genetically compatible, CTL or HTL precursor cells together with a source of antigen-presenting cells (APC), such as dendritic cells, and the appropriate immunogenic peptide. After an appropriate incubation time (typically about 7–28 days), in which the precursor cells are activated and expanded into effector cells, the cells are infused back into the patient, where they will destroy (CTL) or facilitate destruction (HTL) of their specific target cell (e.g., a tumor cell). Transfected dendritic cells may also be used as antigen presenting cells.

X.E. Administration of Vaccines for Therapeutic or Prophylactic Purposes

Pharmaceutical and vaccine compositions of the invention are typically used to treat and/or prevent a cancer that expresses or overexpresses 282P1G3. In therapeutic applications, peptide and/or nucleic acid compositions are administered to a patient in an amount sufficient to elicit an effective B cell, CTL and/or HTL response to the antigen and to cure or at least partially arrest or slow symptoms and/or complications. An amount adequate to accomplish this is defined as "therapeutically effective dose." Amounts effective for this use will depend on, e.g., the particular composition administered, the manner of administration, the stage and severity of the disease being treated, the weight and general state of health of the patient, and the judgment of the prescribing physician.

For pharmaceutical compositions, the immunogenic peptides of the invention, or DNA encoding them, are generally administered to an individual already bearing a tumor that expresses 282P1G3. The peptides or DNA encoding them can be administered individually or as fusions of one or more peptide sequences. Patients can be treated with the immunogenic peptides separately or in conjunction with other treatments, such as surgery, as appropriate.

For therapeutic use, administration should generally begin at the first diagnosis of 282P1G3-associated cancer. This is followed by boosting doses until at least symptoms are substantially abated and for a period thereafter. The embodiment of the vaccine composition (i.e., including, but not limited to embodiments such as peptide cocktails, polyepitopic polypeptides, minigenes, or TAA-specific CTLs or pulsed dendritic cells) delivered to the patient may vary according to the stage of the disease or the patient's health status. For example, in a patient with a tumor that expresses 282P1G3, a vaccine comprising 282P1G3-specific CTL may be more efficacious in killing tumor cells in patient with advanced disease than alternative embodiments.

It is generally important to provide an amount of the peptide epitope delivered by a mode of administration sufficient to stimulate effectively a cytotoxic T cell response;

compositions which stimulate helper T cell responses can also be given in accordance with this embodiment of the invention.

The dosage for an initial therapeutic immunization generally occurs in a unit dosage range where the lower value is about 1, 5, 50, 500, or 1,000 μg and the higher value is about 10,000; 20,000; 30,000; or 50,000 μg. Dosage values for a human typically range from about 500 μg to about 50,000 μg per 70 kilogram patient. Boosting dosages of between about 1.0 μg to about 50,000 μg of peptide pursuant to a boosting regimen over weeks to months may be administered depending upon the patient's response and condition as determined by measuring the specific activity of CTL and HTL obtained from the patient's blood. Administration should continue until at least clinical symptoms or laboratory tests indicate that the neoplasia, has been eliminated or reduced and for a period thereafter. The dosages, routes of administration, and dose schedules are adjusted in accordance with methodologies known in the art.

In certain embodiments, the peptides and compositions of the present invention are employed in serious disease states, that is, life-threatening or potentially life threatening situations. In such cases, as a result of the minimal amounts of extraneous substances and the relative nontoxic nature of the peptides in preferred compositions of the invention, it is possible and may be felt desirable by the treating physician to administer substantial excesses of these peptide compositions relative to these stated dosage amounts.

The vaccine compositions of the invention can also be used purely as prophylactic agents. Generally the dosage for an initial prophylactic immunization generally occurs in a unit dosage range where the lower value is about 1, 5, 50, 500, or 1000 μg and the higher value is about 10,000; 20,000; 30,000; or 50,000 μg. Dosage values for a human typically range from about 500 μg to about 50,000 μg per 70 kilogram patient. This is followed by boosting dosages of between about 1.0 μg to about 50,000 μg of peptide administered at defined intervals from about four weeks to six months after the initial administration of vaccine. The immunogenicity of the vaccine can be assessed by measuring the specific activity of CTL and HTL obtained from a sample of the patient's blood.

The pharmaceutical compositions for therapeutic treatment are intended for parenteral, topical, oral, nasal, intrathecal, or local (e.g. as a cream or topical ointment) administration. Preferably, the pharmaceutical compositions are administered parentally, e.g., intravenously, subcutaneously, intradermally, or intramuscularly. Thus, the invention provides compositions for parenteral administration which comprise a solution of the immunogenic peptides dissolved or suspended in an acceptable carrier, preferably an aqueous carrier.

A variety of aqueous carriers may be used, e.g., water, buffered water, 0.8% saline, 0.3% glycine, hyaluronic acid and the like. These compositions may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions may contain pharmaceutically acceptable auxiliary substances as required to approximate physiological conditions, such as pH-adjusting and buffering agents, tonicity adjusting agents, wetting agents, preservatives, and the like, for example, sodium acetate, sodium lactate, sodium chloride, potassium chloride, calcium chloride, sorbitan monolaurate, triethanolamine oleate, etc.

The concentration of peptides of the invention in the pharmaceutical formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

A human unit dose form of a composition is typically included in a pharmaceutical composition that comprises a human unit dose of an acceptable carrier, in one embodiment an aqueous carrier, and is administered in a volume/quantity that is known by those of skill in the art to be used for administration of such compositions to humans (see, e.g., Remington's Pharmaceutical Sciences, $17^{th}$ Edition, A. Gennaro, Editor, Mack Publishing Co., Easton, Pa., 1985). For example a peptide dose for initial immunization can be from about 1 to about 50,000 μg, generally 100–5,000 μg, for a 70 kg patient. For example, for nucleic acids an initial immunization may be performed using an expression vector in the form of naked nucleic acid administered IM (or SC or ID) in the amounts of 0.5–5 mg at multiple sites. The nucleic acid (0.1 to 1000 μg) can also be administered using a gene gun. Following an incubation period of 3–4 weeks, a booster dose is then administered. The booster can be recombinant fowlpox virus administered at a dose of $5–10^7$ to $5\times10^9$ pfu.

For antibodies, a treatment generally involves repeated administration of the anti-282P1G3 antibody preparation, via an acceptable route of administration such as intravenous injection (IV), typically at a dose in the range of about 0.1 to about 10 mg/kg body weight. In general, doses in the range of 10–500 mg mAb per week are effective and well tolerated. Moreover, an initial loading dose of approximately 4 mg/kg patient body weight IV, followed by weekly doses of about 2 mg/kg IV of the anti-282P1G3 mAb preparation represents an acceptable dosing regimen. As appreciated by those of skill in the art, various factors can influence the ideal dose in a particular case. Such factors include, for example, half life of a composition, the binding affinity of an Ab, the immunogenicity of a substance, the degree of 282P1G3 expression in the patient, the extent of circulating shed 282P1G3 antigen, the desired steady-state concentration level, frequency of treatment, and the influence of chemotherapeutic or other agents used in combination with the treatment method of the invention, as well as the health status of a particular patient. Non-limiting preferred human unit doses are, for example, 500 μg–1 mg, 1 mg–50 mg, 50 mg–100 mg, 100 mg–200 mg, 200 mg–300 mg, 400 mg–500 mg, 500 mg–600 mg, 600 mg–700 mg, 700 mg–800 mg, 800 mg–900 mg, 900 mg–1 g, or 1 mg–700 mg. In certain embodiments, the dose is in a range of 2–5 mg/kg body weight, e.g., with follow on weekly doses of 1–3 mg/kg; 0.5 mg, 1, 2, 3, 4, 5, 6, 7, 8, 9, 10 mg/kg body weight followed, e.g., in two, three or four weeks by weekly doses; 0.5–10 mg/kg body weight, e.g., followed in two, three or four weeks by weekly doses; 225, 250, 275, 300, 325, 350, 375, 400 mg $m^2$ of body area weekly; 1–600 mg $m^2$ of body area weekly; 225–400 mg $m^2$ of body area weekly; these does can be followed by weekly doses for 2, 3, 4, 5, 6, 7, 8, 9, 19, 11, 12 or more weeks.

In one embodiment, human unit dose forms of polynucleotides comprise a suitable dosage range or effective amount that provides any therapeutic effect. As appreciated by one of ordinary skill in the art a therapeutic effect depends on a number of factors, including the sequence of the polynucleotide, molecular weight of the polynucleotide and route of administration. Dosages are generally selected by the physician or other health care professional in accordance with a variety of parameters known in the art, such as severity of symptoms, history of the patient and the like. Generally, for a polynucleotide of about 20 bases, a dosage range may be selected from, for example, an independently selected lower limit such as about 0.1, 0.25, 0.5, 1, 2, 5, 10, 20, 30, 40, 50, 60, 70, 80, 90, 100, 200, 300, 400 or 500 mg/kg up to an independently selected upper limit, greater than the lower limit, of about 60, 80, 100, 200, 300, 400, 500, 750, 1000, 1500, 2000, 3000, 4000, 5000, 6000, 7000, 8000, 9000 or 10,000 mg/kg. For example, a dose may be about any of the following: 0.1 to 100 mg/kg, 0.1 to 50 mg/kg, 0.1 to 25 mg/kg, 0.1 to 10 mg/kg, 1 to 500 mg/kg, 100 to 400 mg/kg, 200 to 300 mg/kg, 1 to 100 mg/kg, 100 to 200 mg/kg, 300 to 400 mg/kg, 400 to 500 mg/kg, 500 to 1000 mg/kg, 500 to 5000 mg/kg, or 500 to 10,000 mg/kg. Generally, parenteral routes of administration may require higher doses of polynucleotide compared to more direct application to the nucleotide to diseased tissue, as do polynucleotides of increasing length.

In one embodiment, human unit dose forms of T-cells comprise a suitable dosage range or effective amount that provides any therapeutic effect. As appreciated by one of ordinary skill in the art, a therapeutic effect depends on a number of factors. Dosages are generally selected by the physician or other health care professional in accordance with a variety of parameters known in the art, such as severity of symptoms, history of the patient and the like. A dose may be about $10^4$ cells to about $10^6$ cells, about $10^6$ cells to about $10^8$ cells, about $10^8$ to about $10^{11}$ cells, or about $10^8$ to about $5\times10^{10}$ cells. A dose may also about $10^6$ cells/$m^2$ to about $10^{10}$ cells/$m^2$, or about $10^6$ cells/$m^2$ to about $10^8$ cells/$m^2$.

Proteins(s) of the invention, and/or nucleic acids encoding the protein(s), can also be administered via liposomes, which may also serve to: 1) target the proteins(s) to a particular tissue, such as lymphoid tissue; 2) to target selectively to diseases cells; or, 3) to increase the half-life of the peptide composition. Liposomes include emulsions, foams, micelles, insoluble monolayers, liquid crystals, phospholipid dispersions, lamellar layers and the like. In these preparations, the peptide to be delivered is incorporated as part of a liposome, alone or in conjunction with a molecule which binds to a receptor prevalent among lymphoid cells, such as monoclonal antibodies which bind to the CD45 antigen, or with other therapeutic or immunogenic compositions. Thus, liposomes either filled or decorated with a desired peptide of the invention can be directed to the site of lymphoid cells, where the liposomes then deliver the peptide compositions. Liposomes for use in accordance with the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka, et al., *Ann. Rev. Biophys. Bioeng*. 9:467 (1980), and U.S. Pat. Nos. 4,235,871, 4,501,728, 4,837,028, and 5,019,369.

For targeting cells of the immune system, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10–95% of active ingredient, that is, one or more peptides of the invention, and more preferably at a concentration of 25%–75%.

For aerosol administration, immunogenic peptides are preferably supplied in finely divided form along with a surfactant and propellant. Typical percentages of peptides are about 0.01%–20% by weight, preferably about 1%–10%. The surfactant must, of course, be nontoxic, and preferably soluble in the propellant. Representative of such agents are the esters or partial esters of fatty acids containing from about 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute about 0.1%–20% by weight of the composition, preferably about 0.25–5%. The balance of the composition is ordinarily propellant. A carrier can also be included, as desired, as with, e.g., lecithin for intranasal delivery.

XI.) Diagnostic and Prognostic Embodiments of 282P1G3.

As disclosed herein, 282P1G3 polynucleotides, polypeptides, reactive cytotoxic T cells (CTL), reactive helper T cells (HTL) and anti-polypeptide antibodies are used in well known diagnostic, prognostic and therapeutic assays that examine conditions associated with dysregulated cell growth such as cancer, in particular the cancers listed in Table I (see, e.g., both its specific pattern of tissue expression as well as its overexpression in certain cancers as described for example in the Example entitled "Expression analysis of 282P1G3 in normal tissues, and patient specimens").

282P1G3 can be analogized to a prostate associated antigen PSA, the archetypal marker that has been used by medical practitioners for years to identify and monitor the presence of prostate cancer (see, e.g., Merrill et al., J. Urol. 163(2): 503–5120 (2000); Polascik et al., J. Urol. August; 162(2):293–306 (1999) and Fortier et al., J. Nat. Cancer Inst. 91(19): 1635–1640(1999)). A variety of other diagnostic markers are also used in similar contexts including p53 and K-ras (see, e.g., Tulchinsky et al., Int J Mol Med 1999 Jul. 4(1):99–102 and Minimoto et al., Cancer Detect Prev 2000; 24(1):1–12). Therefore, this disclosure of 282P1G3 polynucleotides and polypeptides (as well as 282P1G3 polynucleotide probes and anti-282P1G3 antibodies used to identify the presence of these molecules) and their properties allows skilled artisans to utilize these molecules in methods that are analogous to those used, for example, in a variety of diagnostic assays directed to examining conditions associated with cancer.

Typical embodiments of diagnostic methods which utilize the 282P1G3 polynucleotides, polypeptides, reactive T cells and antibodies are analogous to those methods from well-established diagnostic assays, which employ, e.g., PSA polynucleotides, polypeptides, reactive T cells and antibodies. For example, just as PSA polynucleotides are used as probes (for example in Northern analysis, see, e.g., Sharief et al., Biochem. Mol. Biol. Int. 33(3):567–74(1994)) and primers (for example in PCR analysis, see, e.g., Okegawa et al., J. Urol. 163(4): 1189–1190 (2000)) to observe the presence and/or the level of PSA mRNAs in methods of monitoring PSA overexpression or the metastasis of prostate cancers, the 282P1G3 polynucleotides described herein can be utilized in the same way to detect 282P1G3 overexpression or the metastasis of prostate and other cancers expressing this gene. Alternatively, just as PSA polypeptides are used to generate antibodies specific for PSA which can then be used to observe the presence and/or the level of PSA proteins in methods to monitor PSA protein overexpression (see, e.g., Stephan et al., Urology 55(4):560–3 (2000)) or the metastasis of prostate cells (see, e.g., Alanen et al., Pathol. Res. Pract. 192(3):233–7 (1996)), the 282P1G3 polypeptides described herein can be utilized to generate antibodies for use in detecting 282P1G3 overexpression or the metastasis of prostate cells and cells of other cancers expressing this gene.

Specifically, because metastases involves the movement of cancer cells from an organ of origin (such as the lung or prostate gland etc.) to a different area of the body (such as a lymph node), assays which examine a biological sample for the presence of cells expressing 282P1G3 polynucleotides and/or polypeptides can be used to provide evidence of metastasis. For example, when a biological sample from tissue that does not normally contain 282P1G3-expressing cells (lymph node) is found to contain 282P1G3-expressing cells such as the 282P1G3 expression seen in LAPC4 and LAPC9, xenografts isolated from lymph node and bone metastasis, respectively, this finding is indicative of metastasis.

Alternatively 282P1G3 polynucleotides and/or polypeptides can be used to provide evidence of cancer, for example, when cells in a biological sample that do not normally express 282P1G3 or express 282P1G3 at a different level are found to express 282P1G3 or have an increased expression of 282P1G3 (see, e.g., the 282P1G3 expression in the cancers listed in Table I and in patient samples etc. shown in the accompanying Figures). In such assays, artisans may further wish to generate supplementary evidence of metastasis by testing the biological sample for the presence of a second tissue restricted marker (in addition to 282P1G3) such as PSA, PSCA etc. (see, e.g., Alanen et aL, Pathol. Res. Pract. 192(3): 233–237 (1996)).

The use of immunohistochemistry to identify the presence of a 282P1G3 polypeptide within a tissue section can indicate an altered state of certain cells within that tissue. It is well understood in the art that the ability of an antibody to localize to a polypeptide that is expressed in cancer cells is a way of diagnosing presence of disease, disease stage, progression and/or tumor aggressiveness. Such an antibody can also detect an altered distribution of the polypeptide within the cancer cells, as compared to corresponding non-malignant tissue.

The 282P1G3 polypeptide and immunogenic compositions are also useful in view of the phenomena of altered subcellular protein localization in disease states. Alteration of cells from normal to diseased state causes changes in cellular morphology and is often associated with changes in subcellular protein localization/distribution. For example, cell membrane proteins that are expressed in a polarized manner in normal cells can be altered in disease, resulting in distribution of the protein in a non-polar manner over the whole cell surface.

The phenomenon of altered subcellular protein localization in a disease state has been demonstrated with MUC1 and Her2 protein expression by use of immunohistochemical means. Normal epithelial cells have a typical apical distribution of MUC1, in addition to some supranuclear localization of the glycoprotein, whereas malignant lesions often demonstrate an apolar staining pattern (Diaz et al, The Breast Journal, 7; 40–45 (2001); Zhang et al., Clinical Cancer Research, 4; 2669–2676 (1998): Cao, et al, The Journal of Histochemistry and Cytochemistry, 45: 1547–1557 (1997)). In addition, normal breast epithelium is either negative for Her2 protein or exhibits only a basolateral distribution whereas malignant cells can express the protein over the whole cell surface (De Potter, et al, International Journal of Cancer, 44; 969–974 (1989): McCormick, et al, 117; 935–943(2002)). Alternatively, distribution of the protein may be altered from a surface only localization to include diffuse cytoplasmic expression in the diseased state. Such an example can be seen with MUC1 (Diaz, et al, The Breast Journal, 7: 40–45 (2001)).

Alteration in the localization/distribution of a protein in the cell, as detected by immunohistochemical methods, can also provide valuable information concerning the favorability of certain treatment modalities. This last point is illustrated by a situation where a protein may be intracellular in normal tissue, but cell surface in malignant cells; the cell surface location makes the cells favorably amenable to antibody-based diagnostic and treatment regimens. When such an alteration of protein localization occurs for 282P1G3, the 282P1G3 protein and immune responses related thereto are very useful. Accordingly, the ability to determine whether alteration of subcellular protein localization occurred for 24P4C12 make the 282P1G3 protein and immune responses related thereto very useful. Use of the 282P1G3 compositions allows those skilled in the art to make important diagnostic and therapeutic decisions. Immunohistochemical reagents specific to 282P1G3 are also useful to detect metastases of tumors expressing 282P1G3 when the polypeptide appears in tissues where 282P1G3 is not normally produced.

Thus, 282P1G3 polypeptides and antibodies resulting from immune responses thereto are useful in a variety of important contexts such as diagnostic, prognostic, preventative and/or therapeutic purposes known to those skilled in the art.

Just as PSA polynucleotide fragments and polynucleotide variants are employed by skilled artisans for use in methods of monitoring PSA, 282P1G3 polynucleotide fragments and polynucleotide variants are used in an analogous manner. In particular, typical PSA polynucleotides used in methods of monitoring PSA are probes or primers which consist of fragments of the PSA cDNA sequence. Illustrating this, primers used to PCR amplify a PSA polynucleotide must include less than the whole PSA sequence to function in the polymerase chain reaction. In the context of such PCR reactions, skilled artisans generally create a variety of different polynucleotide fragments that can be used as primers in order to amplify different portions of a polynucleotide of interest or to optimize amplification reactions (see, e.g., Caetano-Anolles, G. Biotechniques 25(3): 472–476, 478–480(1998); Robertson et al., Methods Mol. Biol. 98:121–154(1998)). An additional illustration of the use of such fragments is provided in the Example entitled "Expression analysis of 282P1G3 in normal tissues, and patient specimens," where a 282P1G3 polynucleotide fragment is used as a probe to show the expression of 282P1G3 RNAs in cancer cells. In addition, variant polynucleotide sequences are typically used as primers and probes for the corresponding mRNAs in PCR and Northern analyses (see, e.g., Sawai et al., Fetal Diagn. Ther. 1996 November–December 11(6): 407–13 and Current Protocols In Molecular Biology, Volume 2, Unit 2, Frederick M. Ausubel et al. eds. 1995)). Polynucleotide fragments and variants are useful in this context where they are capable of binding to a target polynucleotide sequence (e.g., a 282P1G3 polynucleotide shown in FIG. 2 or variant thereof) under conditions of high stringency.

Furthermore, PSA polypeptides which contain an epitope that can be recognized by an antibody or T cell that specifically binds to that epitope are used in methods of monitoring PSA. 282P1G3 polypeptide fragments and polypeptide analogs or variants can also be used in an analogous manner. This practice of using polypeptide fragments or polypeptide variants to generate antibodies (such as anti-PSA antibodies or T cells) is typical in the art with a wide variety of systems such as fusion proteins being used by practitioners (see, e.g., Current Protocols In Molecular Biology, Volume 2, Unit 16, Frederick M. Ausubel et al. eds., 1995). In this context, each epitope(s) functions to provide the architecture with which an antibody or T cell is reactive. Typically, skilled artisans create a variety of different polypeptide fragments that can be used in order to generate immune responses specific for different portions of a polypeptide of interest (see, e.g., U.S. Pat. No. 5,840,501 and U.S. Pat. No. 5,939,533). For example it may be preferable to utilize a polypeptide comprising one of the 282P1G3 biological motifs discussed herein or a motif-bearing subsequence which is readily identified by one of skill in the art based on motifs available in the art. Polypeptide fragments, variants or analogs are typically useful in this context as long as they comprise an epitope capable of generating an antibody or T cell specific for a target polypeptide sequence (e.g. a 282P1G3 polypeptide shown in FIG. 3).

As shown herein, the 282P1G3 polynucleotides and polypeptides (as well as the 282P1G3 polynucleotide probes and anti-282P1G3 antibodies or T cells used to identify the presence of these molecules) exhibit specific properties that make them useful in diagnosing cancers such as those listed in Table I. Diagnostic assays that measure the presence of 282P1G3 gene products, in order to evaluate the presence or onset of a disease condition described herein, such as prostate cancer, are used to identify patients for preventive measures or further monitoring, as has been done so successfully with PSA. Moreover, these materials satisfy a need in the art for molecules having similar or complementary characteristics to PSA in situations where, for example, a definite diagnosis of metastasis of prostatic origin cannot be made on the basis of a test for PSA alone (see, e.g., Alanen et al., Pathol. Res. Pract. 192(3): 233–237 (1996)), and consequently, materials such as 282P1G3 polynucleotides and polypeptides (as well as the 282P1G3 polynucleotide probes and anti-282P1G3 antibodies used to identify the presence of these molecules) need to be employed to confirm a metastases of prostatic origin.

Finally, in addition to their use in diagnostic assays, the 282P1G3 polynucleotides disclosed herein have a number of other utilities such as their use in the identification of oncogenetic associated chromosomal abnormalities in the chromosomal region to which the 282P1G3 gene maps (see the Example entitled "Chromosomal Mapping of 282P1G3" below). Moreover, in addition to their use in diagnostic assays, the 282P1G3-related proteins and polynucleotides disclosed herein have other utilities such as their use in the forensic analysis of tissues of unknown origin (see, e.g., Takahama K Forensic Sci Int Jun. 28, 1996;80(1–2): 63–9).

Additionally, 282P1G3-related proteins or polynucleotides of the invention can be used to treat a pathologic condition characterized by the over-expression of 282P1G3. For example, the amino acid or nucleic acid sequence of FIG. 2 or FIG. 3, or fragments of either, can be used to generate an immune response to a 282P1G3 antigen. Antibodies or other molecules that react with 282P1G3 can be used to modulate the function of this molecule, and thereby provide a therapeutic benefit.

XII.) Inhibition of 282P1G3 Protein Function

The invention includes various methods and compositions for inhibiting the binding of 282P1G3 to its binding partner or its association with other protein(s) as well as methods for inhibiting 282P1G3 function.

XII.A.) Inhibition of 282P1G3 With Intracellular Antibodies

In one approach, a recombinant vector that encodes single chain antibodies that specifically bind to 282P1G3 are introduced into 282P1G3 expressing cells via gene transfer technologies. Accordingly, the encoded single chain anti-282P1G3 antibody is expressed intracellularly, binds to 282P1G3 protein, and thereby inhibits its function. Methods for engineering such intracellular single chain antibodies are well known. Such intracellular antibodies, also known as "intrabodies", are specifically targeted to a particular compartment within the cell, providing control over where the inhibitory activity of the treatment is focused. This technology has been successfully applied in the art (for review, see Richardson and Marasco, 1995, TIBTECH vol. 13). Intrabodies have been shown to virtually eliminate the expression of otherwise abundant cell surface receptors (see, e.g., Richardson et al., 1995, Proc. Natl. Acad. Sci. USA 92: 3137–3141; Beerli et al., 1994, J. Biol. Chem. 289: 23931–23936; Deshane et al., 1994, Gene Ther. 1: 332–337).

Single chain antibodies comprise the variable domains of the heavy and light chain joined by a flexible linker polypeptide, and are expressed as a single polypeptide. Optionally, single chain antibodies are expressed as a single chain variable region fragment joined to the light chain constant region. Well-known intracellular trafficking signals are engineered into recombinant polynucleotide vectors encoding such single chain antibodies in order to target precisely the intrabody to the desired intracellular compartment. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In one embodiment, intrabodies are used to capture 282P1G3 in the nucleus, thereby preventing its activity within the nucleus. Nuclear targeting signals are engineered into such 282P1G3 intrabodies in order to achieve the desired targeting. Such 282P1G3 intrabodies are designed to bind specifically to a particular 282P1G3 domain. In another embodiment, cytosolic intrabodies that specifically bind to a 282P1G3 protein are used to prevent 282P1G3 from gaining access to the nucleus, thereby preventing it from exerting any biological activity within the nucleus (e.g., preventing 282P1G3 from forming transcription complexes with other factors).

In order to specifically direct the expression of such intrabodies to particular cells, the transcription of the intrabody is placed under the regulatory control of an appropriate tumor-specifc promoter and/or enhancer. In order to target intrabody expression specifically to prostate, for example, the PSA promoter and/or promoter/enhancer can be utilized (See, for example, U.S. Pat. No. 5,919,652 issued 6 Jul. 1999).

XII.B.) Inhibition of 282P1G3 with Recombinant Proteins

In another approach, recombinant molecules bind to 282P1G3 and thereby inhibit 282P1G3 function. For example, these recombinant molecules prevent or inhibit 282P1G3 from accessing/binding to its binding partner(s) or associating with other protein(s). Such recombinant molecules can, for example, contain the reactive part(s) of a 282P1G3 specific antibody molecule. In a particular embodiment, the 282P1G3 binding domain of a 282P1G3 binding partner is engineered into a dimeric fusion protein, whereby the fusion protein comprises two 282P1G3 ligand binding domains linked to the Fc portion of a human IgG, such as human IgG1. Such IgG portion can contain, for example, the $C_H2$ and $C_H3$ domains and the hinge region, but not the $C_H1$ domain. Such dimeric fusion proteins are administered in soluble form to patients suffering from a cancer associated with the expression of 282P1G3, whereby the dimeric fusion protein specifically binds to 282P1G3 and blocks 282P1G3 interaction with a binding partner. Such dimeric fusion proteins are further combined into multimeric proteins using known antibody linking technologies.

XII.C.) Inhibition of 282P1G3 Transcription or Translation

The present invention also comprises various methods and compositions for inhibiting the transcription of the 282P1G3 gene. Similarly, the invention also provides methods and compositions for inhibiting the translation of 282P1G3 mRNA into protein.

In one approach, a method of inhibiting the transcription of the 282P1G3 gene comprises contacting the 282P1G3 gene with a 282P1G3 antisense polynucleotide. In another approach, a method of inhibiting 282P1G3 mRNA translation comprises contacting a 282P1G3 mRNA with an antisense polynucleotide. In another approach, a 282P1G3 specific ribozyme is used to cleave a 282P1G3 message, thereby inhibiting translation. Such antisense and ribozyme based methods can also be directed to the regulatory regions of the 282P1G3 gene, such as 282P1G3 promoter and/or enhancer elements. Similarly, proteins capable of inhibiting a 282P1G3 gene transcription factor are used to inhibit 282P1G3 mRNA transcription. The various polynucleotides and compositions useful in the aforementioned methods have been described above. The use of antisense and ribozyme molecules to inhibit transcription and translation is well known in the art.

Other factors that inhibit the transcription of 282P1G3 by interfering with 282P1G3 transcriptional activation are also useful to treat cancers expressing 282P1G3. Similarly, factors that interfere with 282P1G3 processing are useful to treat cancers that express 282P1G3. Cancer treatment methods utilizing such factors are also within the scope of the invention.

XII.D.) General Considerations for Therapeutic Strategies

Gene transfer and gene therapy technologies can be used to deliver therapeutic polynucleotide molecules to tumor cells synthesizing 282P1G3 (i.e., antisense, ribozyme, polynucleotides encoding intrabodies and other 282P1G3 inhibitory molecules). A number of gene therapy approaches are known in the art. Recombinant vectors encoding 282P1G3 antisense polynucleotides, ribozymes, factors capable of interfering with 282P1G3 transcription, and so forth, can be delivered to target tumor cells using such gene therapy approaches.

The above therapeutic approaches can be combined with any one of a wide variety of surgical, chemotherapy or radiation therapy regimens. The therapeutic approaches of the invention can enable the use of reduced dosages of chemotherapy (or other therapies) and/or less frequent administration, an advantage for all patients and particularly for those that do not tolerate the toxicity of the chemotherapeutic agent well.

The anti-tumor activity of a particular composition (e.g., antisense, ribozyme, intrabody), or a combination of such compositions, can be evaluated using various in vitro and in vivo assay systems. In vitro assays that evaluate therapeutic activity include cell growth assays, soft agar assays and other assays indicative of tumor promoting activity, binding assays capable of determining the extent to which a therapeutic composition will inhibit the binding of 282P1G3 to a binding partner, etc.

In vivo, the effect of a 282P1G3 therapeutic composition can be evaluated in a suitable animal model. For example, xenogenic prostate cancer models can be used, wherein human prostate cancer explants or passaged xenograft tissues are introduced into immune compromised animals, such as nude or SCID mice (Klein et al., 1997, Nature Medicine 3: 402–408). For example, PCT Patent Application WO98/16628 and U.S. Pat. No. 6,107,540 describe various xenograft models of human prostate cancer capable of recapitulating the development of primary tumors, micrometastasis, and the formation of osteoblastic metastases characteristic of late stage disease. Efficacy can be predicted using assays that measure inhibition of tumor formation, tumor regression or metastasis, and the like.

In vivo assays that evaluate the promotion of apoptosis are useful in evaluating therapeutic compositions. In one embodiment, xenografts from tumor bearing mice treated with the therapeutic composition can be examined for the presence of apoptotic foci and compared to untreated control xenograft-bearing mice. The extent to which apoptotic foci are found in the tumors of the treated mice provides an indication of the therapeutic efficacy of the composition.

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences $16^{th}$ Edition, A. Osal., Ed., 1980).

Therapeutic formulations can be solubilized and administered via any route capable of delivering the therapeutic composition to the tumor site. Potentially effective routes of administration include, but are not limited to, intravenous, parenteral, intraperitoneal, intramuscular, intratumor, intradermal, intraorgan, orthotopic, and the like. A preferred formulation for intravenous injection comprises the therapeutic composition in a solution of preserved bacteriostatic water, sterile unpreserved water, and/or diluted in polyvinylchloride or polyethylene bags containing 0.9% sterile Sodium Chloride for Injection, USP. Therapeutic protein preparations can be lyophilized and stored as sterile powders, preferably under vacuum, and then reconstituted in bacteriostatic water (containing for example, benzyl alcohol preservative) or in sterile water prior to injection.

Dosages and administration protocols for the treatment of cancers using the foregoing methods will vary with the method and the target cancer, and will generally depend on a number of other factors appreciated in the art.

XIII.) Identification, Characterization and Use of Modulators of 282P1G3

Methods to Identity and Use Modulators

In one embodiment, screening is performed to identify modulators that induce or suppress a particular expression profile, suppress or induce specific pathways, preferably generating the associated phenotype thereby. In another embodiment, having identified differentially expressed genes important in a particular state; screens are performed to identify modulators that alter expression of individual genes, either increase or decrease. In another embodiment, screening is performed to identify modulators that alter a biological function of the expression product of a differentially expressed gene. Again, having identified the importance of a gene in a particular state, screens are performed to identify agents that bind and/or modulate the biological activity of the gene product.

In addition, screens are done for genes that are induced in response to a candidate agent. After identifying a modulator (one that suppresses a cancer expression pattern leading to a normal expression pattern, or a modulator of a cancer gene that leads to expression of the gene as in normal tissue) a screen is performed to identify genes that are specifically modulated in response to the agent. Comparing expression profiles between normal tissue and agent-treated cancer tissue reveals genes that are not expressed in normal tissue or cancer tissue, but are expressed in agent treated tissue, and vice versa. These agent-specific sequences are identified and used by methods described herein for cancer genes or proteins. In particular these sequences and the proteins they encode are used in marking or identifying agent-treated cells. In addition, antibodies are raised against the agent-induced proteins and used to target novel therapeutics to the treated cancer tissue sample.

Modulator-Related Identification and Screening Assays:

Gene Expression-related Assays

Proteins, nucleic acids, and antibodies of the invention are used in screening assays. The cancer-associated proteins, antibodies, nucleic acids, modified proteins and cells containing these sequences are used in screening assays, such as evaluating the effect of drug candidates on a "gene expression profile," expression profile of polypeptides or alteration of biological function. In one embodiment, the expression profiles are used, preferably in conjunction with high throughput screening techniques to allow monitoring for expression profile genes after treatment with a candidate agent (e.g., Davis, G F, et al, J Biol Screen 7:69 (2002); Zlokarnik, et al., Science 279:84–8 (1998); Heid, Genome Res 6:986–94, 1996).

The cancer proteins, antibodies, nucleic acids, modified proteins and cells containing the native or modified cancer proteins or genes are used in screening assays. That is, the present invention comprises methods for screening for compositions which modulate the cancer phenotype or a physiological function of a cancer protein of the invention. This is done on a gene itself or by evaluating the effect of drug candidates on a "gene expression profile" or biological function. In one embodiment, expression profiles are used, preferably in conjunction with high throughput screening techniques to allow monitoring after treatment with a candidate agent, see Zlokamik, supra.

A variety of assays are executed directed to the genes and proteins of the invention. Assays are run on an individual nucleic acid or protein level. That is, having identified a particular gene as up regulated in cancer, test compounds are screened for the ability to modulate gene expression or for binding to the cancer protein of the invention. "Modulation" in this context includes an increase or a decrease in gene expression. The preferred amount of modulation will depend on the original change of the gene expression in normal versus tissue undergoing cancer, with changes of at least 10%, preferably 50%, more preferably 100–300%, and in some embodiments 300–1000% or greater. Thus, if a gene exhibits a 4-fold increase in cancer tissue compared to normal tissue, a decrease of about four-fold is often desired; similarly, a 10-fold decrease in cancer tissue compared to normal tissue a target value of a 10-fold increase in expression by the test compound is often desired. Modulators that exacerbate the type of gene expression seen in cancer are also useful, e.g., as an upregulated target in further analyses.

The amount of gene expression is monitored using nucleic acid probes and the quantification of gene expression levels, or, alternatively, a gene product itself is monitored, e.g., through the use of antibodies to the cancer protein and standard immunoassays. Proteomics and separation techniques also allow for quantification of expression.

Expression Monitoring to Identify Compounds that Modify Gene Expression

In one embodiment, gene expression monitoring, i.e., an expression profile, is monitored simultaneously for a number of entities. Such profiles will typically involve one or more of the genes of FIG. 2. In this embodiment, e.g., cancer nucleic acid probes are attached to biochips to detect and quantify cancer sequences in a particular cell. Alternatively, PCR can be used. Thus, a series, e.g., wells of a microtiter plate, can be used with dispensed primers in desired wells. A PCR reaction can then be performed and analyzed for each well.

Expression monitoring is performed to identify compounds that modify the expression of one or more cancer-associated sequences, e.g., a polynucleotide sequence set out in FIG. 2. Generally, a test modulator is added to the cells prior to analysis. Moreover, screens are also provided to identify agents that modulate cancer, modulate cancer proteins of the invention, bind to a cancer protein of the invention, or interfere with the binding of a cancer protein of the invention and an antibody or other binding partner.

In one embodiment, high throughput screening methods involve providing a library containing a large number of potential therapeutic compounds (candidate compounds). Such "combinatorial chemical libraries" are then screened in one or more assays to identify those library members (particular chemical species or subclasses) that display a desired characteristic activity. The compounds thus identified can serve as conventional "lead compounds," as compounds for screening, or as therapeutics.

In certain embodiments, combinatorial libraries of potential modulators are screened for an ability to bind to a cancer polypeptide or to modulate activity. Conventionally, new chemical entities with useful properties are generated by identifying a chemical compound (called a "lead compound") with some desirable property or activity, e.g., inhibiting activity, creating variants of the lead compound, and evaluating the property and activity of those variant compounds. Often, high throughput screening (HTS) methods are employed for such an analysis.

As noted above, gene expression monitoring is conveniently used to test candidate modulators (e.g., protein, nucleic acid or small molecule). After the candidate agent has been added and the cells allowed to incubate for a period, the sample containing a target sequence to be analyzed is, e.g., added to a biochip.

If required, the target sequence is prepared using known techniques. For example, a sample is treated to lyse the cells, using known lysis buffers, electroporation, etc., with purification and/or amplification such as PCR performed as appropriate. For example, an in vitro transcription with labels covalently attached to the nucleotides is performed. Generally, the nucleic acids are labeled with biotin-FITC or PE, or with cy3 or cy5.

The target sequence can be labeled with, e.g., a fluorescent, a chemiluminescent, a chemical, or a radioactive signal, to provide a means of detecting the target sequence's specific binding to a probe. The label also can be an enzyme, such as alkaline phosphatase or horseradish peroxidase, which when provided with an appropriate substrate produces a product that is detected. Alternatively, the label is a labeled compound or small molecule, such as an enzyme inhibitor, that binds but is not catalyzed or altered by the enzyme. The label also can be a moiety or compound, such as, an epitope tag or biotin which specifically binds to streptavidin. For the example of biotin, the streptavidin is labeled as described above, thereby, providing a detectable signal for the bound target sequence. Unbound labeled streptavidin is typically removed prior to analysis.

As will be appreciated by those in the art, these assays can be direct hybridization assays or can comprise "sandwich assays", which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124, 246; and 5,681,697. In this embodiment, in general, the target nucleic acid is prepared as outlined above, and then added to the biochip comprising a plurality of nucleic acid probes, under conditions that allow the formation of a hybridization complex.

A variety of hybridization conditions are used in the present invention, including high, moderate and low stringency conditions as outlined above. The assays are generally run under stringency conditions which allow formation of the label probe hybridization complex only in the presence of target. Stringency can be controlled by altering a step parameter that is a thermodynamic variable, including, but not limited to, temperature, formamide concentration, salt concentration, chaotropic salt concentration pH, organic solvent concentration, etc. These parameters may also be used to control non-specific binding, as is generally outlined in U.S. Pat. No. 5,681,697. Thus, it can be desirable to perform certain steps at higher stringency conditions to reduce non-specific binding.

The reactions outlined herein can be accomplished in a variety of ways. Components of the reaction can be added simultaneously, or sequentially, in different orders, with preferred embodiments outlined below. In addition, the reaction may include a variety of other reagents. These include salts, buffers, neutral proteins, e.g. albumin, detergents, etc. which can be used to facilitate optimal hybridization and detection, and/or reduce nonspecific or background interactions. Reagents that otherwise improve the efficiency of the assay, such as protease inhibitors, nuclease inhibitors, anti-microbial agents, etc., may also be used as appropriate, depending on the sample preparation methods and purity of the target. The assay data are analyzed to determine the expression levels of individual genes, and changes in expression levels as between states, forming a gene expression profile.

Biological Activity-related Assays

The invention provides methods identify or screen for a compound that modulates the activity of a cancer-related gene or protein of the invention. The methods comprise adding a test compound, as defined above, to a cell comprising a cancer protein of the invention. The cells contain a recombinant nucleic acid that encodes a cancer protein of the invention. In another embodiment, a library of candidate agents is tested on a plurality of cells.

In one aspect, the assays are evaluated in the presence or absence or previous or subsequent exposure of physiological signals, e.g. hormones, antibodies, peptides, antigens, cytokines, growth factors, action potentials, pharmacological agents including chemotherapeutics, radiation, carcinogenics, or other cells (i.e., cell-cell contacts). In another example, the determinations are made at different stages of the cell cycle process. In this way, compounds that modulate genes or proteins of the invention are identified. Compounds with pharmacological activity are able to enhance or interfere with the activity of the cancer protein of the invention. Once identified, similar structures are evaluated to identify critical structural features of the compound.

In one embodiment, a method of modulating (e.g., inhibiting) cancer cell division is provided; the method comprises administration of a cancer modulator. In another embodiment, a method of modulating (e.g., inhibiting) cancer is provided; the method comprises administration of a cancer modulator. In a further embodiment, methods of treating cells or individuals with cancer are provided; the method comprises administration of a cancer modulator.

In one embodiment, a method for modulating the status of a cell that expresses a gene of the invention is provided. As used herein status comprises such art-accepted parameters such as growth, proliferation, survival, function, apoptosis, senescence, location, enzymatic activity, signal transduction, etc. of a cell. In one embodiment, a cancer inhibitor is an antibody as discussed above. In another embodiment, the cancer inhibitor is an antisense molecule. A variety of cell growth, proliferation, and metastasis assays are known to those of skill in the art, as described herein.

High Throughput Screening to Identify Modulators

The assays to identify suitable modulators are amenable to high throughput screening. Preferred assays thus detect enhancement or inhibition of cancer gene transcription, inhibition or enhancement of polypeptide expression, and inhibition or enhancement of polypeptide activity.

In one embodiment, modulators evaluated in high throughput screening methods are proteins, often naturally occurring proteins or fragments of naturally occurring proteins. Thus, e.g., cellular extracts containing proteins, or random or directed digests of proteinaceous cellular extracts, are used. In this way, libraries of proteins are made for screening in the methods of the invention. Particularly preferred in this embodiment are libraries of bacterial, fungal, viral, and mammalian proteins, with the latter being preferred, and human proteins being especially preferred. Particularly useful test compound will be directed to the class of proteins to which the target belongs, e.g., substrates for enzymes, or ligands and receptors.

Use of Soft Agar Growth and Colony Formation to Identify and Characterize Modulators Normal cells require a solid substrate to attach and grow. When cells are transformed, they lose this phenotype and grow detached from the substrate. For example, transformed cells can grow in stirred suspension culture or suspended in semi-solid media, such as semi-solid or soft agar. The transformed cells, when transfected with tumor suppressor genes, can regenerate normal phenotype and once again require a solid substrate to attach to and grow. Soft agar growth or colony formation in assays are used to identify modulators of cancer sequences, which when expressed in host cells, inhibit abnormal cellular proliferation and transformation. A modulator reduces or eliminates the host cells' ability to grow suspended in solid or semisolid media, such as agar.

Techniques for soft agar growth or colony formation in suspension assays are described in Freshney, Culture of Animal Cells a Manual of Basic Technique (3rd ed., 1994). See also, the methods section of Garkavtsev et al. (1996), supra.

Evaluation of Contact Inhibition and Growth Density Limitation to Identify and Characterize Modulators Normal cells typically grow in a flat and organized pattern in cell culture until they touch other cells. When the cells touch one another, they are contact inhibited and stop growing. Transformed cells, however, are not contact inhibited and continue to grow to high densities in disorganized foci. Thus, transformed cells grow to a higher saturation density than corresponding normal cells. This is detected morphologically by the formation of a disoriented monolayer of cells or cells in foci. Alternatively, labeling index with ($^3$H)-thymidine at saturation density is used to measure density limitation of growth, similarly an MTT or Alamar blue assay will reveal proliferation capacity of cells and the the ability of modulators to affect same. See Freshney (1994), supra. Transformed cells, when transfected with tumor suppressor genes, can regenerate a normal phenotype and become contact inhibited and would grow to a lower density.

In this assay, labeling index with $^3$H)-thymidine at saturation density is a preferred method of measuring density limitation of growth. Transformed host cells are transfected with a cancer-associated sequence and are grown for 24 hours at saturation density in non-limiting medium conditions. The percentage of cells labeling with ($^3$H)-thymidine is determined by incorporated cpm.

Contact independent growth is used to identify modulators of cancer sequences, which had led to abnormal cellular proliferation and transformation. A modulator reduces or eliminates contact independent growth, and returns the cells to a normal phenotype.

Evaluation of Growth Factor or Serum Dependence to Identify and Characterize Modulators Transformed cells have lower serum dependence than their normal counterparts (see, e.g., Temin, J. Natl. Cancer Inst. 37:167–175 (1966); Eagle et al., J. Exp. Med 131: 836–879 (1970)); Freshney, supra. This is in part due to release of various growth factors by the transformed cells. The degree of growth factor or serum dependence of transformed host cells can be compared with that of control. For example, growth factor or serum dependence of a cell is monitored in methods to identify and characterize compounds that modulate cancer-associated sequences of the invention.

Use of Tumor-Specific Marker Levels to Identify and Characterize Modulators

Tumor cells release an increased amount of certain factors (hereinafter "tumor specific markers") than their normal counterparts. For example, plasminogen activator (PA) is released from human glioma at a higher level than from normal brain cells (see, e.g., Gullino, Angiogenesis, Tumor Vascularization, and Potential Interference with Tumor Growth, in Biological Responses in Cancer, pp. 178–184 (Mihich (ed.) 1985)). Similarly, Tumor Angiogenesis Factor (TAF) is released at a higher level in tumor cells than their normal counterparts. See, e.g., Folkman, Angiogenesis and Cancer, Sem Cancer Biol. (1992)), while bFGF is released from endothelial tumors (Ensoli, B et al).

Various techniques which measure the release of these factors are described in Freshney (1994), supra. Also, see, Unkless et al., J. Biol. Chem. 249:4295–4305 (1974); Strickland & Beers, J. Biol. Chem. 251:5694–5702 (1976); Whur et al., Br. J. Cancer 42:305 312 (1980); Gullino, Angiogenesis, Tumor Vascularization, and Potential Interference with Tumor Growth, in Biological Responses in Cancer, pp. 178–184 (Mihich (ed.) 1985); Freshney, Anticancer Res. 5:111–130 (1985). For example, tumor specific marker levels are monitored in methods to identify and characterize compounds that modulate cancer-associated sequences of the invention.

Invasiveness into Matrigel to Identify and Characterize Modulators

The degree of invasiveness into Matrigel or an extracellular matrix constituent can be used as an assay to identify and characterize compounds that modulate cancer associated sequences. Tumor cells exhibit a positive correlation between malignancy and invasiveness of cells into Matrigel or some other extracellular matrix constituent. In this assay, tumorigenic cells are typically used as host cells. Expression of a tumor suppressor gene in these host cells would decrease invasiveness of the host cells. Techniques described in Cancer Res. 1999; 59:6010; Freshney (1994), supra, can be used. Briefly, the level of invasion of host cells is measured by using filters coated with Matrigel or some other extracellular matrix constituent. Penetration into the gel, or through to the distal side of the filter, is rated as invasiveness, and rated histologically by number of cells and distance moved, or by prelabeling the cells with $^{125}$1 and counting the radioactivity on the distal side of the filter or bottom of the dish. See, e.g., Freshney (1984), supra.

Evaluation of Tumor Growth In Vivo to Identify and Characterize Modulators

Effects of cancer-associated sequences on cell growth are tested in transgenic or immune-suppressed organisms. Transgenic organisms are prepared in a variety of art-accepted ways. For example, knock-out transgenic organisms, e.g., mammals such as mice, are made, in which a cancer gene is disrupted or in which a cancer gene is inserted. Knock-out transgenic mice are made by insertion of a marker gene or other heterologous gene into the endogenous cancer gene site in the mouse genome via homologous recombination. Such mice can also be made by substituting the endogenous cancer gene with a mutated version of the cancer gene, or by mutating the endogenous cancer gene, e.g., by exposure to carcinogens.

To prepare transgenic chimeric animals, e.g., mice, a DNA construct is introduced into the nuclei of embryonic stem cells. Cells containing the newly engineered genetic lesion are injected into a host mouse embryo, which is re-implanted into a recipient female. Some of these embryos develop into chimeric mice that possess germ cells some of which are derived from the mutant cell line. Therefore, by breeding the chimeric mice it is possible to obtain a new line of mice containing the introduced genetic lesion (see, e.g., Capecchi et al., Science 244:1288 (1989)). Chimeric mice can be derived according to U.S. Pat. No. 6,365,797, issued 2 Apr. 2002; U.S. Pat. No. 6,107,540 issued 22 Aug. 2000; Hogan et al., Manipulating the Mouse Embryo: A laboratory Manual, Cold Spring Harbor Laboratory (1988) and Teratocarcinomas and Embryonic Stem Cells: A Practical Approach, Robertson, ed., IRL Press, Washington, D.C., (1987).

Alternatively, various immune-suppressed or immune-deficient host animals can be used. For example, a genetically athymic "nude" mouse (see, e.g., Giovanella et al., J. Natl. Cancer Inst. 52:921 (1974)), a SCID mouse, a thymectornized mouse, or an irradiated mouse (see, e.g., Bradley et al., Br. J. Cancer 38:263 (1978); Selby et al., Br. J. Cancer 41:52 (1980)) can be used as a host. Transplantable tumor cells (typically about $10^6$ cells) injected into isogenic hosts produce invasive tumors in a high proportion of cases, while normal cells of similar origin will not. In hosts which developed invasive tumors, cells expressing cancer-associated sequences are injected subcutaneously or orthotopically. Mice are then separated into groups, including control groups and treated experimental groups) e.g. treated with a modulator). After a suitable length of time, preferably 4–8 weeks, tumor growth is measured (e.g., by volume or by its two largest dimensions, or weight) and compared to the control. Tumors that have statistically significant reduction (using, e.g., Student's T test) are said to have inhibited growth.

In Vitro Assays to Identify and Characterize Modulators

Assays to identify compounds with modulating activity can be performed in vitro. For example, a cancer polypeptide is first contacted with a potential modulator and incubated for a suitable amount of time, e.g., from 0.5 to 48 hours. In one embodiment, the cancer polypeptide levels are determined in vitro by measuring the level of protein or mRNA. The level of protein is measured using immunoassays such as Western blotting, ELISA and the like with an antibody that selectively binds to the cancer polypeptide or a fragment thereof. For measurement of mRNA, amplification, e.g., using PCR, LCR, or hybridization assays, e. g., Northern hybridization, RNAse protection, dot blotting, are preferred. The level of protein or mRNA is detected using directly or indirectly labeled detection agents, e.g., fluorescently or radioactively labeled nucleic acids, radioactively or enzymatically labeled antibodies, and the like, as described herein.

Alternatively, a reporter gene system can be devised using a cancer protein promoter operably linked to a reporter gene such as luciferase, green fluorescent protein, CAT, or P-gal. The reporter construct is typically transfected into a cell. After treatment with a potential modulator, the amount of reporter gene transcription, translation, or activity is measured according to standard techniques known to those of skill in the art (Davis G F, supra; Gonzalez, J. & Negulescu, P. Curr. Opin. Biotechnol. 1998: 9:624).

As outlined above, in vitro screens are done on individual genes and gene products. That is, having identified a particular differentially expressed gene as important in a particular state, screening of modulators of the expression of the gene or the gene product itself is performed.

In one embodiment, screening for modulators of expression of specific gene(s) is performed. Typically, the expression of only one or a few genes is evaluated. In another embodiment, screens are designed to first find compounds that bind to differentially expressed proteins. These compounds are then evaluated for the ability to modulate differentially expressed activity. Moreover, once initial candidate compounds are identified, variants can be further screened to better evaluate structure activity relationships.

Binding Assays to Identify and Characterize Modulators

In binding assays in accordance with the invention, a purified or isolated gene product of the invention is generally used. For example, antibodies are generated to a protein of the invention, and immunoassays are run to determine the amount and/or location of protein. Alternatively, cells comprising the cancer proteins are used in the assays.

Thus, the methods comprise combining a cancer protein of the invention and a candidate compound such as a ligand, and determining the binding of the compound to the cancer protein of the invention. Preferred embodiments utilize the human cancer protein; animal models of human disease of can also be developed and used. Also, other analogous mammalian proteins also can be used as appreciated by those of skill in the art. Moreover, in some embodiments variant or derivative cancer proteins are used.

Generally, the cancer protein of the invention, or the ligand, is non-diffusibly bound to an insoluble support. The support can, e.g., be one having isolated sample receiving areas (a microtiter plate, an array, etc.). The insoluble supports can be made of any composition to which the compositions can be bound, is readily separated from soluble material, and is otherwise compatible with the overall method of screening. The surface of such supports can be solid or porous and of any convenient shape.

Examples of suitable insoluble supports include microtiter plates, arrays, membranes and beads. These are typically made of glass, plastic (e.g., polystyrene), polysaccharide, nylon, nitrocellulose, or Teflon™, etc. Microtiter plates and arrays are especially convenient because a large number of assays can be carried out simultaneously, using small amounts of reagents and samples. The particular manner of binding of the composition to the support is not crucial so long as it is compatible with the reagents and overall methods of the invention, maintains the activity of the composition and is nondiffusable. Preferred methods of binding include the use of antibodies which do not sterically block either the ligand binding site or activation sequence when attaching the protein to the support, direct binding to "sticky" or ionic supports, chemical crosslinking, the synthesis of the protein or agent on the surface, etc. Following binding of the protein or ligand/binding agent to the support, excess unbound material is removed by washing. The sample receiving areas may then be blocked through incubation with bovine serum albumin (BSA), casein or other innocuous protein or other moiety.

Once a cancer protein of the invention is bound to the support, and a test compound is added to the assay. Alternatively, the candidate binding agent is bound to the support and the cancer protein of the invention is then added. Binding agents include specific antibodies, non-natural binding agents identified in screens of chemical libraries, peptide analogs, etc.

Of particular interest are assays to identify agents that have a low toxicity for human cells. A wide variety of assays can be used for this purpose, including proliferation assays, cAMP assays, labeled in vitro protein-protein binding assays, electrophoretic mobility shift assays, immunoassays for protein binding, functional assays (phosphorylation assays, etc.) and the like.

A determination of binding of the test compound (ligand, binding agent, modulator, etc.) to a cancer protein of the invention can be done in a number of ways. The test compound can be labeled, and binding determined directly, e.g., by attaching all or a portion of the cancer protein of the invention to a solid support, adding a labeled candidate compound (e.g., a fluorescent label), washing off excess reagent, and determining whether the label is present on the solid support. Various blocking and washing steps can be utilized as appropriate.

In certain embodiments, only one of the components is labeled, e.g., a protein of the invention or ligands labeled. Alternatively, more than one component is labeled with different labels, e.g., $I^{125}$, for the proteins and a fluorophor for the compound. Proximity reagents, e.g., quenching or energy transfer reagents are also useful.

Competitive Binding to Identify and Characterize Modulators

In one embodiment, the binding of the "test compound" is determined by competitive binding assay with a "competitor." The competitor is a binding moiety that binds to the target molecule (e.g., a cancer protein of the invention). Competitors include compounds such as antibodies, peptides, binding partners, ligands, etc. Under certain circumstances, the competitive binding between the test compound and the competitor displaces the test compound. In one embodiment, the test compound is labeled. Either the test compound, the competitor, or both, is added to the protein for a time sufficient to allow binding. Incubations are performed at a temperature that facilitates optimal activity, typically between four and 40° C. Incubation periods are typically optimized, e.g., to facilitate rapid high throughput screening; typically between zero and one hour will be sufficient. Excess reagent is generally removed or washed away. The second component is then added, and the presence or absence of the labeled component is followed, to indicate binding.

In one embodiment, the competitor is added first, followed by the test compound. Displacement of the competitor is an indication that the test compound is binding to the cancer protein and thus is capable of binding to, and potentially modulating, the activity of the cancer protein. In this embodiment, either component can be labeled. Thus, e.g., if the competitor is labeled, the presence of label in the post-test compound wash solution indicates displacement by the test compound. Alternatively, if the test compound is labeled, the presence of the label on the support indicates displacement.

In an alternative embodiment, the test compound is added first, with incubation and washing, followed by the competitor. The absence of binding by the competitor indicates that the test compound binds to the cancer protein with higher affinity than the competitor. Thus, if the test compound is labeled, the presence of the label on the support, coupled with a lack of competitor binding, indicates that the test compound binds to and thus potentially modulates the cancer protein of the invention.

Accordingly, the competitive binding methods comprise differential screening to identity agents that are capable of modulating the activity of the cancer proteins of the invention. In this embodiment, the methods comprise combining a cancer protein and a competitor in a first sample. A second sample comprises a test compound, the cancer protein, and a competitor. The binding of the competitor is determined for both samples, and a change, or difference in binding between the two samples indicates the presence of an agent capable of binding to the cancer protein and potentially modulating its activity. That is, if the binding of the competitor is different in the second sample relative to the first sample, the agent is capable of binding to the cancer protein.

Alternatively, differential screening is used to identify drug candidates that bind to the native cancer protein, but cannot bind to modified cancer proteins. For example the structure of the cancer protein is modeled and used in rational drug design to synthesize agents that interact with that site, agents which generally do not bind to site-modified proteins. Moreover, such drug candidates that affect the activity of a native cancer protein are also identified by screening drugs for the ability to either enhance or reduce the activity of such proteins.

Positive controls and negative controls can be used in the assays. Preferably control and test samples are performed in at least triplicate to obtain statistically significant results. Incubation of all samples occurs for a time sufficient to allow for the binding of the agent to the protein. Following incubation, samples are washed free of non-specifically bound material and the amount of bound, generally labeled agent determined. For example, where a radiolabel is employed, the samples can be counted in a scintillation counter to determine the amount of bound compound.

A variety of other reagents can be included in the screening assays. These include reagents like salts, neutral proteins, e.g. albumin, detergents, etc. which are used to facilitate optimal protein-protein binding and/or reduce non-specific or background interactions. Also reagents that otherwise improve the efficiency of the assay, such as protease inhibitors, nuclease inhibitors, anti-microbial agents, etc., can be used. The mixture of components is added in an order that provides for the requisite binding.

Use of Polynucleotides to Down-Regulate or Inhibit a Protein of the Invention.

Polynucleotide modulators of cancer can be introduced into a cell containing the target nucleotide sequence by formation of a conjugate with a ligand-binding molecule, as described in WO 91/04753. Suitable ligand-binding molecules include, but are not limited to, cell surface receptors, growth factors, other cytokines, or other ligands that bind to cell surface receptors. Preferably, conjugation of the ligand binding molecule does not substantially interfere with the ability of the ligand binding molecule to bind to its corresponding molecule or receptor, or block entry of the sense or antisense oligonucleotide or its conjugated version into the cell. Alternatively, a polynucleotide modulator of cancer can be introduced into a cell containing the target nucleic acid sequence, e.g., by formation of a polynucleotide-lipid complex, as described in WO 90/10448. It is understood that the use of antisense molecules or knock out and knock in models may also be used in screening assays as discussed above, in addition to methods of treatment.

Inhibitory and Antisense Nucleotides

In certain embodiments, the activity of a cancer-associated protein is down-regulated, or entirely inhibited, by the use of antisense polynucleotide or inhibitory small nuclear RNA (snRNA), i.e., a nucleic acid complementary to, and which can preferably hybridize specifically to, a coding mRNA nucleic acid sequence, e.g., a cancer protein of the invention, mRNA, or a subsequence thereof. Binding of the antisense polynucleotide to the mRNA reduces the translation and/or stability of the mRNA.

In the context of this invention, antisense polynucleotides can comprise naturally occurring nucleotides, or synthetic species formed from naturally occurring subunits or their close homologs. Antisense polynucleotides may also have altered sugar moieties or inter-sugar linkages. Exemplary among these are the phosphorothioate and other sulfur containing species which are known for use in the art. Analogs are comprised by this invention so long as they function effectively to hybridize with nucleotides of the invention. See, e.g., Isis Pharmaceuticals, Carlsbad, Calif.; Sequitor, Inc., Natick, Mass.

Such antisense polynucleotides can readily be synthesized using recombinant means, or can be synthesized in vitro. Equipment for such synthesis is sold by several vendors, including Applied Biosystems. The preparation of other oligonucleotides such as phosphorothioates and alkylated derivatives is also well known to those of skill in the art.

Antisense molecules as used herein include antisense or sense oligonucleotides. Sense oligonucleotides can, e.g., be employed to block transcription by binding to the anti-sense strand. The antisense and sense oligonucleotide comprise a single stranded nucleic acid sequence (either RNA or DNA) capable of binding to target mRNA (sense) or DNA (antisense) sequences for cancer molecules. Antisense or sense oligonucleotides, according to the present invention, comprise a fragment generally at least about 12 nucleotides, preferably from about 12 to 30 nucleotides. The ability to derive an antisense or a sense oligonucleotide, based upon a cDNA sequence encoding a given protein is described in, e.g., Stein & Cohen (Cancer Res. 48:2659 (1988 and van der Krol et al. (BioTechniques 6:958 (1988)).

Ribozymes

In addition to antisense polynucleotides, ribozymes can be used to target and inhibit transcription of cancer-associated nucleotide sequences. A ribozyme is an RNA molecule that catalytically cleaves other RNA molecules. Different kinds of ribozymes have been described, including group I ribozymes, hammerhead ribozymes, hairpin ribozymes, RNase P, and axhead ribozymes (see, e.g., Castanotto et al., Adv. in Pharmacology 25: 289–317 (1994) for a general review of the properties of different ribozymes).

The general features of hairpin ribozymes are described, e.g., in Hampel et al., Nucl. Acids Res. 18:299–304 (1990); European Patent Publication No. 0360257; U.S. Pat. No. 5,254,678. Methods of preparing are well known to those of skill in the art (see, e.g., WO 94/26877; Ojwang et al., Proc. Natl. Acad. Sci. USA 90:6340–6344 (1993); Yamada et al., Human Gene Therapy 1:39–45 (1994); Leavitt et al., Proc. Natl. Acad Sci. USA 92:699–703 (1995); Leavitt et al., Human Gene Therapy 5: 1151–120 (1994); and Yamada et al., Virology 205:121–126 (1994)).

Use of Modulators in Phenotypic Screening

In one embodiment, a test compound is administered to a population of cancer cells, which have an associated cancer expression profile. By "administration" or "contacting" herein is meant that the modulator is added to the cells in such a manner as to allow the modulator to act upon the cell, whether by uptake and intracellular action, or by action at the cell surface. In some embodiments, a nucleic acid encoding a proteinaceous agent (i.e., a peptide) is put into a viral construct such as an adenoviral or retroviral construct, and added to the cell, such that expression of the peptide agent is accomplished, e.g., PCT US97/01019. Regulatable gene therapy systems can also be used. Once the modulator has been administered to the cells, the cells are washed if desired and are allowed to incubate under preferably physiological conditions for some period. The cells are then harvested and a new gene expression profile is generated. Thus, e.g., cancer tissue is screened for agents that modulate, e.g., induce or suppress, the cancer phenotype. A change in at least one gene, preferably many, of the expression profile indicates that the agent has an effect on cancer activity. Similarly, altering a biological function or a signaling pathway is indicative of modulator activity. By defining such a signature for the cancer phenotype, screens for new drugs that alter the phenotype are devised. With this approach, the drug target need not be known and need not be represented in the original gene/protein expression screening platform, nor does the level of transcript for the target protein need to change. The modulator inhibiting function will serve as a surrogate marker As outlined above, screens are done to assess genes or gene products. That is, having identified a particular differentially expressed gene as important in a particular state, screening of modulators of either the expression of the gene or the gene product itself is performed.

Use of Modulators to Affect Peptides of the Invention

Measurements of cancer polypeptide activity, or of the cancer phenotype are performed using a variety of assays. For example, the effects of modulators upon the function of a cancer polypeptide(s) are measured by examining parameters described above. A physiological change that affects activity is used to assess the influence of a test compound on the polypeptides of this invention. When the functional outcomes are determined using intact cells or animals, a variety of effects can be assesses such as, in the case of a cancer associated with solid tumors, tumor growth, tumor metastasis, neovascularization, hormone release, transcriptional changes to both known and uncharacterized genetic markers (e.g., by Northern blots), changes in cell metabolism such as cell growth or pH changes, and changes in intracellular second messengers such as cGNIP.

Methods of Identifying Characterizing Cancer-associated Sequences

Expression of various gene sequences is correlated with cancer. Accordingly, disorders based on mutant or variant cancer genes are determined. In one embodiment, the invention provides methods for identifying cells containing variant cancer genes, e.g., determining the presence of, all or part, the sequence of at least one endogenous cancer gene in a cell. This is accomplished using any number of sequencing techniques. The invention comprises methods of identifying the cancer genotype of an individual, e.g., determining all or part of the sequence of at least one gene of the invention in the individual. This is generally done in at least one tissue of the individual, e.g., a tissue set forth in Table I, and may include the evaluation of a number of tissues or different samples of the same tissue. The method may include comparing the sequence of the sequenced gene to a known cancer gene, i.e., a wild-type gene to determine the presence of family members, homologies, mutations or variants. The sequence of all or part of the gene can then be compared to the sequence of a known cancer gene to determine if any differences exist. This is done using any number of known homology programs, such as BLAST, Bestfit, etc. The presence of a difference in the sequence between the cancer gene of the patient and the known cancer gene correlates with a disease state or a propensity for a disease state, as outlined herein.

In a preferred embodiment, the cancer genes are used as probes to determine the number of copies of the cancer gene in the genome. The cancer genes are used as probes to determine the chromosomal localization of the cancer genes. Information such as chromosomal localization finds use in providing a diagnosis or prognosis in particular when chromosomal abnormalities such as translocations, and the like are identified in the cancer gene locus.

XIV.) Kits/Articles of Manufacture

For use in the laboratory, prognostic, prophylactic, diagnostic and therapeutic applications described herein, kits are within the scope of the invention. Such kits can comprise a carrier, package, or container that is compartmentalized to receive one or more containers such as vials, tubes, and the like, each of the container(s) comprising one of the separate elements to be used in the method, along with a label or insert comprising instructions for use, such as a use described herein. For example, the container(s) can comprise a probe that is or can be detectably labeled. Such probe can be an antibody or polynucleotide specific for a protein or a gene or message of the invention, respectively. Where the method utilizes nucleic acid hybridization to detect the target nucleic acid, the kit can also have containers containing nucleotide(s) for amplification of the target nucleic acid sequence. Kits can comprise a container comprising a reporter, such as a biotin-binding protein, such as avidin or streptavidin, bound to a reporter molecule, such as an enzymatic, fluorescent, or radioisotope label; such a reporter can be used with, e.g., a nucleic acid or antibody. The kit can include all or part of the amino acid sequences in FIG. 2 or FIG. 3 or analogs thereof, or a nucleic acid molecule that encodes such amino acid sequences.

The kit of the invention will typically comprise the container described above and one or more other containers associated therewith that comprise materials desirable from a commercial and user standpoint, including buffers, diluents, filters, needles, syringes; carrier, package, container, vial and/or tube labels listing contents and/or instructions for use, and package inserts with instructions for use.

A label can be present on or with the container to indicate that the composition is used for a specific therapy or non-therapeutic application, such as a prognostic, prophylactic, diagnostic or laboratory application, and can also indicate directions for either in vivo or in vitro use, such as those described herein. Directions and or other information can also be included on an insert(s) or label(s) which is included with or on the kit. The label can be on or associated with the container. A label a can be on a container when letters, numbers or other characters forming the label are molded or etched into the container itself; a label can be associated with a container when it is present within a receptacle or carrier that also holds the container, e.g., as a package insert. The label can indicate that the composition is used for diagnosing, treating, prophylaxing or prognosing a condition, such as a neoplasia of a tissue set forth in Table I.

The terms "kit" and "article of manufacture" can be used as synonyms.

In another embodiment of the invention, an article(s) of manufacture containing compositions, such as amino acid sequence(s), small molecule(s), nucleic acid sequence(s), and/or antibody(s), e.g., materials useful for the diagnosis, prognosis, prophylaxis and/or treatment of neoplasias of tissues such as those set forth in Table I is provided. The article of manufacture typically comprises at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container comprises an antibody, binding fragment thereof or specific binding protein for use in evaluating protein expression of282P1G3 in cells and tissues or for relevant laboratory, prognostic, diagnostic, prophylactic and therapeutic purposes; indications and/or directions for such uses can be included on or with such container, as can reagents and other compositions or tools used for these purposes. In another embodiment, a container comprises materials for eliciting a cellular or humoral immune response, together with associated indications and/or directions. In another embodiment, a container comprises materials for adoptive immunotherapy, such as cytotoxic T cells (CTL) or helper T cells (HTL), together with associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be an antibody capable of specifically binding 282P1G3 and modulating the function of 282P1G3.

The article of manufacture can further comprise a second container comprising a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

EXAMPLES

Various aspects of the invention are further described and illustrated by way of the several examples that follow, none of which are intended to limit the scope of the invention.

Example 1

SSH-Generated Isolation of cDNA Fragment of the 282P1G3Gene

To isolate genes that are over-expressed in pancreatic cancer we used the Suppression Subtractive Hybridization (SSH) procedure using cDNA derived from pancreatic cancer tissues. The 282P1G3 SSH cDNA sequence was derived from pancreatic tumor minus cDNAs derived from normal pancreas. The 282P1G3 cDNA was identified as highly expressed in the pancreas cancer.

Materials and Methods

Human Tissues:

The patient cancer and normal tissues were purchased from different sources such as the NDRI (Philadelphia, Pa.). mRNA for some normal tissues were purchased from Clontech, Palo Alto, Calif.

RNA Isolation:

Tissues were homogenized in Trizol reagent (Life Technologies, Gibco BRL) using 10 ml/g tissue isolate total RNA. Poly A RNA was purified from total RNA using Qiagen's Oligotex mRNA Mini and Midi kits. Total and mRNA were quantified by spectrophotometric analysis (O.D. 260/280 nm) and analyzed by gel electrophoresis.

Oligonucleotides:

The following HPLC purified oligonucleotides were used:

DPNCDN (cDNA synthesis primer):

5'TTTTGATCAAGCTT$_{30}$3' (SEQ ID NO: 41)

Adaptor 1:

```
                                    (SEQ ID NO: 42)
5'CTAATACGACTCACTATAGGGCTCGAGCGGCCGCCCGGGCAG3'

                                    (SEQ ID NO: 43)
3'GGCCCGTCCTAG5'
```

Adaptor 2:

```
                                (SEQ ID NO: 44)
5'GTAATACGACTCACTATAGGGCAGCGTGGTCGCGGCCGAG3'

                                (SEQ ID NO: 45)
3'CGGCTCCTAG5'
```

PCR Primer 1:
5'CTAATACGACTCACTATAGGGC3' (SEQ ID NO: 46)
Nested Primer (NP)1:
5'TCGAGCGGCCGCCCGGGCAGGA3' (SEQ ID NO: 47)
Nested Primer (NP)2:
5'AGCGTGGTCGCGGCCGAGGA3' (SEQ ID NO: 48)
Suppression Subtractive Hybridization:

Suppression Subtractive Hybridization (SSH) was used to identify cDNAs corresponding to genes that may be differentially expressed in pancreas cancer. The SSH reaction utilized cDNA from pancreas cancer and normal tissues.

The gene 282P1G3 sequence was derived from pancreas cancer minus normal pancreas cDNA subtraction. The SSH DNA sequence (FIG. 1) was identified.

The cDNA derived from normal pancreas mixed with a pool of 9 normal tissues was used as the source of the "driver" cDNA, while the cDNA from pancreas cancer was used as the source of the "tester" cDNA. Double stranded cDNAs corresponding to tester and driver cDNAs were synthesized from 2 μg of poly(A)$^+$ RNA isolated from the relevant xenograft tissue, as described above, using CLONTECH's PCR-Select cDNA Subtraction Kit and 1 ng of oligonucleotide DPNCDN as primer. First- and second-strand synthesis were carried out as described in the Kit's user manual protocol (CLONTECH Protocol No. PT1117-1, Catalog No. K1804-1). The resulting cDNA was digested with Dpn II for 3 hrs at 37° C. Digested cDNA was extracted with phenol/chloroform (1:1) and ethanol precipitated.

Driver cDNA was generated by combining in a 1:1 ratio Dpn II digested cDNA from normal pancreas with a mix of digested cDNAs derived from the nine normal tissues: stomach, skeletal muscle, lung, brain, liver, kidney, pancreas, small intestine, and heart.

Tester cDNA was generated by diluting 1 μl of Dpn II digested cDNA from the relevant tissue source (see above) (400 ng) in 5 μl of water. The diluted cDNA (2 μl, 160 ng) was then ligated to 2 μl of Adaptor 1 and Adaptor 2 (10 μM), in separate ligation reactions, in a total volume of 10 μl at 16° C. overnight, using 400 u of T4 DNA ligase (CLONTECH). Ligation was terminated with 1 μl of 0.2 M EDTA and heating at 72° C. for 5 min.

The first hybridization was performed by adding 1.5 μl (600 ng) of driver cDNA to each of two tubes containing 1.5 μl (20 ng) Adaptor 1- and Adaptor 2-ligated tester cDNA. In a final volume of 4 μl, the samples were overlaid with mineral oil, denatured in an MJ Research thermal cycler at 98° C. for 1.5 minutes, and then were allowed to hybridize for 8 hrs at 68° C. The two hybridizations were then mixed together with an additional 1 μl of fresh denatured driver cDNA and were allowed to hybridize overnight at 68° C. The second hybridization was then diluted in 200 μl of 20 mM Hepes, pH 8.3, 50 mM NaCl, 0.2 mM EDTA, heated at 70° C. for 7 min. and stored at −20° C.

PCR Amplification, Cloning and Sequencing of Gene Fragments Generated from SSH:

To amplify gene fragments resulting from SSH reactions, two PCR amplifications were performed. In the primary PCR reaction 1 μl of the diluted final hybridization mix was added to 1 μl of PCR primer 1 (10 μM), 0.5 μl dNTP mix (10 μM), 2.5 μl 10×reaction buffer (CLONTECH) and 0.5 μl 50×Advantage cDNA polymerase Mix (CLONTECH) in a final volume of 25 μl. PCR 1 was conducted using the following conditions: 75° C. for 5 min., 94° C. for 25 sec., then 27 cycles of 94° C. for 10 sec, 66° C. for 30 sec, 72° C. for 1.5 min. Five separate primary PCR reactions were performed for each experiment. The products were pooled and diluted 1:10 with water. For the secondary PCR reaction, 1 μl from the pooled and diluted primary PCR reaction was added to the same reaction mix as used for PCR 1, except that primers NP1 and NP2 (10 μM) were used instead of PCR primer 1. PCR 2 was performed using 10–12 cycles of 94° C. for 10 sec, 68° C. for 30 sec, and 72° C. for 1.5 minutes. The PCR products were analyzed using 2% agarose gel electrophoresis.

The PCR products were inserted into pCR2.1 using the T/A vector cloning kit (Invitrogen). Transformed *E. coli* were subjected to blue/white and ampicillin selection. White colonies were picked and arrayed into 96 well plates and were grown in liquid culture overnight. To identify inserts, PCR amplification was performed on 1 μl of bacterial culture using the conditions of PCR1 and NP1 and NP2 as primers. PCR products were analyzed using 2% agarose gel electrophoresis.

Bacterial clones were stored in 20% glycerol in a 96 well format. Plasmid DNA was prepared, sequenced, and subjected to nucleic acid homology searches of the GenBank, dBest, and NCI-CGAP databases.

RT-PCR Expression Analysis:

First strand cDNAs can be generated from 1 μg of mRNA with oligo (dT)12–18 priming using the Gibco-BRL Superscript Preamplification system. The manufacturer's protocol was used which included an incubation for 50 min at 42° C. with reverse transcriptase followed by RNAse H treatment at 37° C. for 20 min. After completing the reaction, the volume can be increased to 200 μl with water prior to normalization. First strand cDNAs from 16 different normal human tissues can be obtained from Clontech.

Normalization of the first strand cDNAs from multiple tissues was performed by using the primers 5'atatcgccgcgctcgtcgtcgacaa3' (SEQ ID NO: 49) and 5'agccacacgcagctcattgtagaagg 3' (SEQ ID NO: 50) to amplify β-actin. First strand cDNA (5 μl) were amplified in a total volume of 50 μl containing 0.4 μM primers, 0.2 μM each dNTPs, 1×PCR buffer (Clontech, 10 mM Tris-HCL, 1.5 mM $MgCl_2$, 50 mM KCl, pH8.3) and 1×Klentaq DNA polymerase (Clontech). Five μl of the PCR reaction can be removed at 18, 20, and 22 cycles and used for agarose gel electrophoresis. PCR was performed using an MJ Research thermal cycler under the following conditions: Initial denaturation can be at 94° C. for 15 sec, followed by a 18, 20, and 22 cycles of 94° C. for 15, 65° C. for 2 min, 72° C. for 5 sec. A final extension at 72° C. was carried out for 2 min. After agarose gel electrophoresis, the band intensities of the 283 bp β-actin bands from multiple tissues were compared by visual inspection. Dilution factors for the first strand cDNAs were calculated to result in equal β-actin band intensities in all tissues after 22 cycle PCR. Three rounds of normalization can be required to achieve equal band intensities in all tissues after 22 cycles of PCR.

To determine expression levels of the 282P1G3 gene, 5 μl of normalized first strand cDNA were analyzed by PCR using 26, and 30 cycles of amplification. Semi-quantitative expression analysis can be achieved by comparing the PCR products at cycle numbers that give light band intensities.

The primers used for RT-PCR were designed using the 282P1G3 SSH sequence and are listed below:

```
282P1G3.1
5'-TAAGGTCTCAGCTGTAAACCAAAAG-3'   (SEQ ID NO: 51)

282P1G3.2
5'-CTGTTTTAAGATTGTTGGAACCTGT-3'   (SEQ ID NO: 52)
```

A typical RT-PCR expression analysis is shown in FIG. 14. First strand cDNA was prepared from vital pool 1 (liver, lung and kidney), vital pool 2 (pancreas, colon and stomach), normal pancreas, ovary cancer pool, and pancreas cancer pool. Normalization was performed by PCR using primers to actin and GAPDH. Semi-quantitative PCR, using primers to 282P1G3, was performed at 26 and 30 cycles of amplification. Expression of 282P1G3 was detected in ovary cancer pool, pancreas cancer pool vital pool 1, but not in vital pool 2 nor in normal pancreas.

Example 2

Isolation of Full Length 282P1G3 Encoding cDNA

The 282P1G3 SSH cDNA sequence was derived from a substraction consisting of pancreas cancer minus a normal pancreas. The SSH cDNA sequence of 321 bp (FIG. 1) was designated 282P1G3.

282P1G3 v.2 of 3464 bp was cloned from a pool of normal tissue cDNA library, revealing an ORF of 1171 amino acids (FIG. 2 and FIG. 3). Other variants of 282P1G3 were also identified and these are listed in FIG. 2 and FIG. 3.

282P1G3 v.1, v.9, v.10, v.11, v.24 and v.25 proteins are 1224 amino acids in length and differ from each other by one amino acid as shown in FIG. 11. 282P1G3 v.12 through v.23, v.26 and v.27 are SNP variants and code for the same protein as 282P1G3 v.1. 282P1G3 v.2, v.3, v.4, v.5, v.6, v.7, and v.8 are splice variants of 282P1G3 v.1 and code for proteins of 1171, 893, 1117, 1208, 1183, 1236, and 1195 amino acids, respectively. 282P1G3 v.28 is a splice variant identified by the 282P1G3 SSH, and deletes the second exon of v.1.

282P1G3 v.1 shows 99% identity over 7650 nucleotides to cell adhesion molecule with homology to L1CAM (close homolog of L1) (CHL1), accession number NM_006614. It is a neural recognition molecule that may be involved in signal transduction pathways. 282P1G3 v.2 is a novel splice variant of 282P1G3 and has not been previously described.

Example 3

Chromosomal Mapping of 282P1G3

Chromosomal localization can implicate genes in disease pathogenesis. Several chromosome mapping approaches are available including fluorescent in situ hybridization (FISH), human/hamster radiation hybrid (RH) panels (Walter et al., 1994; Nature Genetics 7:22; Research Genetics, Huntsville Ala.), human-rodent somatic cell hybrid panels such as is available from the Cornell Institute (Camden, N.J.), and genomic viewers utilizing BLAST homologies to sequenced and mapped genomic clones (NCBI, Bethesda, Md.).

282P1G3 maps to chromosome 3p26.1 using 282P1G3 sequence and the NCBI BLAST tool located on the World Wide Web.

Example 4

Expression Analysis of 282P1G3 in Normal Tissues and Patient Specimens

Expression analysis by RT-PCR demonstrated that 282P1G3 is strongly expressed in pancreas cancer and ovary cancer patient specimens (FIG. 14). First strand cDNA was prepared from (A) vital pool 1 (liver, lung and kidney), vital pool 2 (pancreas, colon and stomach), normal pancreas, ovary cancer pool, and pancreas cancer pool; (B) normal stomach, normal brain, normal heart, normal liver, normal skeletal muscle, normal testis, normal prostate, normal bladder, normal kidney, normal colon, normal lung, normal pancreas, and a pool of cancer specimens from pancreas cancer patients, ovary cancer patients, and cancer metastasis specimens. Normalization was performed by PCR using primers to actin. Semi-quantitative PCR, using primers to 282P1G3, was performed at 26 and 30 cycles of amplification. (A) Expression of 282P1G3 was detected in ovary cancer pool, pancreas cancer pool vital pool 1, but not in vital pool 2 nor in norm pancreas. (B) Samples were run on an agarose gel, and PCR products were quantitated using the AlphaImager software. Results show strong expression in pancreas cancer, ovary cancer, cancer metastasis, and normal brain compared to all other normal tissues tested.

Extensive expression of 282P1G3 in normal tissues is shown in FIG. 15. Two multiple tissue northern blots (Clontech) both with 2 μg of mRNA/lane were probed with the 282P1G3 sequence. Size standards in kilobases (kb) are indicated on the side. Results show expression of an approximately 9–10 kb transcript in normal but not in any other normal tissue tested.

Expression of 282P1G3 in pancreas cancer patient specimens is shown in FIG. 16. RNA was extracted from pancreas cancer cell lines (CL), normal pancreas (N), and pancreas cancer patient tumor (T). Northern blots with 10 μg of total RNA were probed with the 282P1G3 SSH fragment. Size standards in kilobases are on the side. Results show expression of 282P1G3 in pancreas cancer patient tumor specimen but not in the cell lines nor in the normal pancreas.

Expression of 282P1G3 was also detected in ovary cancer patient specimens (FIG. 17). RNA was extracted from ovary cancer cell lines (CL), normal ovary (N), and ovary cancer patient tumor (T). Northern blots with 10 μg of total RNA were probed with the 282P1G3 DNA probe. Size standards in kilobases are on the side. Results show expression of 282P1G3 in ovary cancer patient tumor specimen but not in the cell lines nor in the normal ovary.

FIG. 18 shows expression of 282P1G3 in lymphoma cancer patient specimens. RNA was extracted from peripheral blood lymphocytes, cord blood isolated from normal individuals, and from lymphoma patient cancer specimens. Northern blots with 10 μg of total RNA were probed with the 282P1G3 sequence. Size standards in kilobases are on the side. Results show expression of 282P1G3 in lymphoma patient specimens but not in the normal blood cells tested. The restricted expression of 282P1G3 in normal tissues and the expression detected in cancer patient specimens suggest that 282P1G3 is a potential therapeutic target and a diagnostic marker for human cancers.

Example 5

Transcript Variants of 282P1G3

Transcript variants are variants of mature mRNA from the same gene which arise by alternative transcription or alternative splicing. Alternative transcripts are transcripts from the same gene but start transcription at different points. Splice variants are mRNA variants spliced differently from the same transcript. In eukaryotes, when a multi-exon gene is transcribed from genomic DNA, the initial RNA is spliced to produce functional mRNA, which has only exons and is used for translation into an amino acid sequence. Accordingly, a given gene can have zero to many alternative transcripts and each transcript can have zero to many splice variants. Each transcript variant has a unique exon makeup, and can have different coding and/or non-coding (5' or 3' end) portions, from the original transcript. Transcript variants can code for similar or different proteins with the same or a similar function or can encode proteins with different functions, and can be expressed in the same tissue at the same time, or in different tissues at the same time, or in the same tissue at different times, or in different tissues at different times. Proteins encoded by transcript variants can have similar or different cellular or extracellular localizations, e.g., secreted versus intracellular.

Transcript variants are identified by a variety of art-accepted methods. For example, alternative transcripts and splice variants are identified by full-length cloning experiment, or by use of full-length transcript and EST sequences. First, all human ESTs were grouped into clusters which show direct or indirect identity with each other. Second, ESTs in the same cluster were further grouped into sub-clusters and assembled into a consensus sequence. The original gene sequence is compared to the consensus sequence(s) or other full-length sequences. Each consensus sequence is a potential splice variant for that gene. Even when a variant is identified that is not a full-length clone, that portion of the variant is very useful for antigen generation and for further cloning of the full-length splice variant, using techniques known in the art.

Moreover, computer programs are available in the art that identify transcript variants based on genomic sequences. Genomic-based transcript variant identification programs include FgenesH (A. Salamov and V. Solovyev, "Ab initio gene finding in *Drosophila* genomic DNA," Genome Research. 2000 April;10(4):516–22); Grail and GenScan. For a general discussion of splice variant identification protocols see., e.g., Southan, C., A genomic perspective on human proteases, FEBS Lett. 2001 Jun. 8; 498(2–3):214–8; de Souza, S. J., et al., Identification of human chromosome 22 transcribed sequences with ORF expressed sequence tags, Proc. Natl Acad Sci USA. 2000 Nov. 7; 97(23):12690–3.

To further confirm the parameters of a transcript variant, a variety of techniques are available in the art, such as full-length cloning, proteomic validation, PCR-based validation, and 5' RACE validation, etc. (see e.g., Proteomic Validation: Brennan, S. O., et al., Albumin banks peninsula: a new termination variant characterized by electrospray mass spectrometry, Biochem Biophys Acta. Aug. 17, 1999; 1433(1–2):321–6; Ferranti P, et al., Differential splicing of pre-messenger RNA produces multiple forms of mature caprine alpha(s1)-casein, Eur J Biochem. Oct. 1, 1997;249(1):1–7. For PCR-based Validation: Wellmann S, et al., Specific reverse transcription-PCR quantification of vascular endothelial growth factor (VEGF) splice variants by LightCycler technology, Clin Chem. 2001 April;47(4):654–60; Jia, H. P., et al., Discovery of new human beta-defensins using a genomics-based approach, Gene. Jan. 24, 2001; 263(1–2):211–8. For PCR-based and 5' RACE Validation: Brigle, K. E., et al., Organization of the murine reduced folate carrier gene and identification of variant splice forms, Biochem Biophys Acta. Aug 7, 1997; 1353(2):191–8).

It is known in the art that genomic regions are modulated in cancers. When the genomic region to which a gene maps is modulated in a particular cancer, the alternative transcripts or splice variants of the gene are modulated as well. Disclosed herein is that 282P1G03 has a particular expression profile related to cancer. Alternative transcripts and splice variants of 282P1G03 may also be involved in cancers in the same or different tissues, thus serving as tumor-associated markers/antigens.

Using the full-length gene and EST sequences, eight additional transcript variants were identified, designated as 282P1G03 v.2, v.3, v.4, v.5, v.6, v.7, v.8 and v.28. The boundaries of exons in the original transcript, 282P1G03 v.1 were shown in Table LI. FIG. 12 shows the structures of the transcript variants. Theoretically, each different combination of exons in spatial order (aligned on the genomic sequence), e.g. exons 2, 3, 5, 7, and 9–28 of v.1, is a potential splice variant. Tables LII(a)–(h) through LV(a)–(h) are set forth on a variant-by-variant bases. Tables LII(a)–(h) show the nucleotide sequence of the transcript variant. Tables LIII(a)–(h) show the alignment of the transcript variant with nucleic acid sequence of 282P1G03 v.1. Tables LIV(a)–(h) show the amino acid translation of the transcript variant for the identified reading frame orientation. Tables LV(a)–(h) display alignments of the amino acid sequence encoded by the splice variant with that of 282P1G03 v.1.

Example 6

Single Nucleotide Polymorphisms of 282P1G3

A Single Nucleotide Polymorphism (SNP) is a single base pair variation in a nucleotide sequence at a specific location. At any given point of the genome, there are four possible nucleotide base pairs: A/T, C/G, G/C and T/A. Genotype refers to the specific base pair sequence of one or more locations in the genome of an individual. Haplotype refers to the base pair sequence of more than one location on the same DNA molecule (or the same chromosome in higher organisms), often in the context of one gene or in the context of several tightly linked genes. SNP that occurs on a cDNA is called cSNP. This cSNP may change amino acids of the protein encoded by the gene and thus change the functions of the protein. Some SNP cause inherited diseases; others contribute to quantitative variations in phenotype and reactions to environmental factors including diet and drugs among individuals. Therefore, SNP and/or combinations of alleles (called haplotypes) have many applications, including diagnosis of inherited diseases, determination of drug reactions and dosage, identification of genes responsible for diseases, and analysis of the genetic relationship between individuals (P. Nowotny, J. M. Kwon and A. M. Goate, "SNP analysis to dissect human traits," Curr. Opin. Neurobiol. 2001 October; 11 (5):637–641; M. Pirmohamed and B. K. Park, "Genetic susceptibility to adverse drug reactions," Trends Pharmacol. Sci. 2001 June; 22(6):298–305; J. H. Riley, C. J. Allan, E. Lai and A. Roses, "The use of single nucleotide polymorphisms in the isolation of common disease genes," Pharmacogenomics. 2000 February;

1(1):39–47; R. Judson, J. C. Stephens and A. Windemuth, "The predictive power of haplotypes in clinical response," Pharmacogenomics. 2000 February; 1(1):15–26).

SNP are identified by a variety of art-accepted methods (P. Bean, "The promising voyage of SNP target discovery," Am. Clin. Lab. 2001 October–November; 20(9):18–20; K. M. Weiss, "In search of human variation," Genome Res. 1998 July; 8(7):691–697; M. M. She, "Enabling large-scale pharmacogenetic studies by high-throughput mutation detection and genotyping technologies," Clin. Chem. 2001 February; 47(2):164–172). For example, SNP can be identified by sequencing DNA fragments that show polymorphism by gel-based methods such as restriction fragment length polymorphism (RFLP) and denaturing gradient gel electrophoresis (DGGE). They can also be discovered by direct sequencing of DNA samples pooled from different individuals or by comparing sequences from different DNA samples. With the rapid accumulation of sequence data in public and private databases, one can discover SNP by comparing sequences using computer programs (Z. Gu, L. Hillier and P. Y. Kwok, "Single nucleotide polymorphism hunting in cyberspace," Hum. Mutat. 1998; 12(4):221–225). SNP can be verified and genotype or haplotype of an individual can be determined by a variety of methods including direct sequencing and high throughput microarrays (P. Y. Kwok, "Methods for genotyping single nucleotide polymorphisms," Annu. Rev. Genomics Hum. Genet. 2001; 2:235–258; M. Kokoris, K. Dix, K. Moynihan, J. Mathis, B. Erwin, P. Grass, B. Hines and A. Duesterhoeft, "High-throughput SNP genotyping with the Masscode system," Mol. Diagn. 2000 December; 5(4):329–340).

Using the methods described above, 19 SNP were identified in the original transcript, 282P1G03 v.1, at positions 320 (c/t), 668 (c/t), 1178 (a/g), 3484 (c/t), 4615 (g/a), 4636 (-/t), 5078 (c/t), 5530 (t/a), 5812 (c/t), 6114 (a/g), 6229 (c/t), 6383 (g/a), 6626 (c/t), 6942 (c/t), 7085 (c/t), 2684 (a/g), 3864 (t/c), 5768 (t/c) and 6125 (c/t). The transcripts or proteins with alternative allele were designated as variant 282P1G03 v.9 through v.25, as shown in FIG. 10. FIG. 11 shows the schematic alignment of protein variants, corresponding to nucleotide variants. Nucleotide variants that code for the same amino acid sequence as v.1 are not shown in FIG. 11. These alleles of the SNP, though shown separately here, can occur in different combinations (haplotypes) and in any one of the transcript variants (such as 282P1G03 v.2) that contains the site of the SNP.

Example 7

Production of Recombinant 282P1G3 in Prokaryotic Systems

To express recombinant 282P1G3 and 282P1G3 variants in prokaryotic cells, the full or partial length 282P1G3 and 282P1G3 variant cDNA sequences are cloned into any one of a variety of expression vectors known in the art. One or more of the following regions of 282P1G3 variants are expressed: the full length sequence presented in FIGS. 2 and 3, or any 8, 9, 10, 11, 12, 13, 14, 15, 16, 17, 18, 19, 20, 21, 22, 23, 24, 25, 26, 27, 28, 29, 30 or more contiguous amino acids from 282P1G3, variants, or analogs thereof.

A. In vitro Transcription and Translation Constructs:

pCRII: To generate 282P1G3 sense and anti-sense RNA probes for RNA in situ investigations, pCRII constructs (Invitrogen, Carlsbad Calif.) are generated encoding either all or fragments of the 282P1G3 cDNA. The pCRII vector has Sp6 and T7 promoters flanking the insert to drive the transcription of 282P1G3 RNA for use as probes in RNA in situ hybridization experiments. These probes are used to analyze the cell and tissue expression of 282P1G3 at the RNA level. Transcribed 282P1G3 RNA representing the cDNA amino acid coding region of the 282P1G3 gene is used in in vitro translation systems such as the TnT™ Coupled Reticulolysate System (Promega, Corp., Madison, Wis.) to synthesize 282P1G3 protein.

B. Bacterial Constructs:

pGEX Constructs: To generate recombinant 282P1G3 proteins in bacteria that are fused to the Glutathione S-transferase (GST) protein, all or parts of the 282P1G3 cDNA protein coding sequence are cloned into the pGEX family of GST-fusion vectors (Amersham Pharmacia Biotech, Piscataway, N.J.). These constructs allow controlled expression of recombinant 282P1G3 protein sequences with GST fused at the amino-terminus and a six histidine epitope (6×His) at the carboxyl-terminus. The GST and 6×His tags permit purification of the recombinant fusion protein from induced bacteria with the appropriate affinity matrix and allow recognition of the fusion protein with anti-GST and anti-His antibodies. The 6×His tag is generated by adding 6 histidine codons to the cloning primer at the 3' end, e.g., of the open reading frame (ORF). A proteolytic cleavage site, such as the PreScission™ recognition site in pGEX-6P-1, may be employed such that it permits cleavage of the GST tag from 282P1G3-related protein. The ampicillin resistance gene and pBR322 origin permits selection and maintenance of the pGEX plasmids in *E coli.* pMAL Constructs: To generate, in bacteria, recombinant 282P1G3 proteins that are fused to maltose-binding protein (MBP), all or parts of the 282P1G3 cDNA protein coding sequence are fused to the MBP gene by cloning into the pMAL-c2X and pMAL-p2X vectors (New England Biolabs, Beverly, Mass.). These constructs allow controlled expression of recombinant 282P1G3 protein sequences with MBP fused at the amino-terminus and a 6×His epitope tag at the carboxyl-terminus. The MBP and 6×His tags permit purification of the recombinant protein from induced bacteria with the appropriate affinity matrix and allow recognition of the fusion protein with anti-MBP and anti-His antibodies. The 6×His epitope tag is generated by adding 6 histidine codons to the 3' cloning primer. A Factor Xa recognition site permits cleavage of the pMAL tag from 282P1G3. The pMAL-c2X and pMAL-p2X vectors are optimized to express the recombinant protein in the cytoplasm or periplasm respectively. Periplasm expression enhances folding of proteins with disulfide bonds.

pET Constructs: To express 282P1G3 in bacterial cells, all or parts of the 282P1G3 cDNA protein coding sequence are cloned into the pET family of vectors (Novagen, Madison, Wis.). These vectors allow tightly controlled expression of recombinant 282P1G3 protein in bacteria with and without fusion to proteins that enhance solubility, such as NusA and thioredoxin (Trx), and epitope tags, such as 6×His and S-Tag™ that aid purification and detection of the recombinant protein. For example, constructs are made utilizing pET NusA fusion system 43.1 such that regions of the 282P1G3 protein are expressed as amino-terminal fusions to NusA.

C. Yeast Constructs:

pESC Constructs: To express 282P1G3 in the yeast species Saccharomyces cerevisiae for generation of recombinant protein and functional studies, all or parts of the 282P1G3 cDNA protein coding sequence are cloned into the pESC family of vectors each of which contain 1 of 4 selectable markers, HIS3, TRP1, LEU2, and URA3 (Stratagene, La Jolla, Calif.). These vectors allow controlled expression from the same plasmid of up to 2 different genes or cloned sequences containing either Flag™ or Myc epitope tags in the same yeast cell. This system is useful to confirm protein-protein interactions of 282P1G3. In addition, expression in yeast yields similar post-translational modifications, such as glycosylations and phosphorylations that are found when expressed in eukaryotic cells.

PESP Constructs: To express 282P1G3 in the yeast species Saccharomyces pombe, all or parts of the 282P1G3 cDNA protein coding sequence are cloned into the pESP family of vectors. These vectors allow controlled high level of expression of a 282P1G3 protein sequence that is fused at either the amino terminus or at the carboxyl terminus to GST which aids purifcation of the recombinant protein. A Flag™ epitope tag allows detection of the recombinant protein with anti-Flag™ antibody.

Example 8

Production of Recombinant 282P1G3 in Higher Eukaryotic Systems

A. Mammalian Constructs:

To express recombinant 282P1G3 in eukaryotic cells, the full or partial length 282P1G3 cDNA sequences cloned into any one of a variety of expression vectors known in the art. One or more of the following regions of 282P1G3 were expressed in these constructs, amino acids 1 to 1224, or any 8, 9, 10, 11, 12, 13, 14, 15, 16, 17, 18, 19, 20, 21, 22, 23, 24, 25, 26, 27, 28, 29, 30 or more contiguous amino acids from 282P1G3 v.1, and v.9 through v.25; amino acids 1 to 117, 1 to 893, 1 to 1117, 1 to 1208, 1 to 1183, 1 to 1236, 1 to 1195 of v.2, v.3, v.4, v.5, v.6, v.7, and v.8 respectively; or any 8, 9, 10, 11, 12, 13, 14, 15, 16, 17, 18, 19, 20, 21, 22, 23, 24, 25, 26, 27, 28, 29, 30 or more contiguous amino acids from 282P1G3 variants, or analogs thereof.

The constructs can be transfected into any one of a wide variety of mammalian cells such as 293T cells. Transfected 293T cell lysates can be probed with the anti-282P1G3 polyclonal serum, described herein.

pcDNA4/HisMax Constructs: To express 282P1G3 in mammalian cells, a 282P1G3 ORF, or portions thereof, of 282P1G3 are cloned into pcDNA4/HisMax Version A (Invitrogen, Carlsbad, Calif.). Protein expression is driven from the cytomegalovirus (CMV) promoter and the SP16 translational enhancer. The recombinant protein has Xpress™ and six histidine (6×His) epitopes fused to the amino-terminus. The pcDNA4/HisMax vector also contains the bovine growth hormone (BGH) polyadenylation signal and transcription termination sequence to enhance mRNA stability along with the SV40 origin for episomal replication and simple vector rescue in cell lines expressing the large T antigen. The Zeocin resistance gene allows for selection of mammalian cells expressing the protein and the ampicillin resistance gene and ColE1 origin permits selection and maintenance of the plasmid in *E. coli.* pcDNA3.1/MycHis Constructs: To express 282P1G3 in mammalian cells, a 282P1G3 ORF, or portions thereof, of 282P1G3 with a consensus Kozak translation initiation site is cloned into pcDNA3.1/MycHis Version A (Invitrogen, Carlsbad, Calif.). Protein expression is driven from the cytomegalovirus (CMV) promoter. The recombinant proteins have the myc epitope and 6×His epitope fused to the carboxyl-terminus. The pcDNA3.1/MycHis vector also contains the bovine growth hormone (BGH) polyadenylation signal and transcription termination sequence to enhance mRNA stability, along with the SV40 origin for episomal replication and simple vector rescue in cell lines expressing the large T antigen. The Neomycin resistance gene can be used, as it allows for selection of mammalian cells expressing the protein and the ampicillin resistance gene and ColE1 origin permits selection and maintenance of the plasmid in *E. coli.*

The complete ORF of 282P1G3 v.2 was cloned into the pcDNA3.1/MycHis construct to generate 282P1G3.pcDNA3.1/MycHis. FIG. 19 shows expression of 282P1G3.pcDNA3.1/MycHis following transfection into 293T cells. 293T cells were transfected with either 282P1G3.pcDNA3.1/MycHis or pcDNA3.1/MycHis vector control. Forty hours later, cell lysates were collected. Samples were run on an SDS-PAGE acrylamide gel, blotted and stained with anti-his antibody. The blot was developed using the ECL chemiluminescence kit and visualized by autoradiography. Results show expression of 282P1G3 from the 282P1G3.pcDNA3.1/MycHis construct in the lysates of transfected cells.

pcDNA3.1/CT-GFP-TOPO Construct: To express 282P1G3 in mammalian cells and to allow detection of the recombinant proteins using fluorescence, a 282P1G3 ORF, or portions thereof, with a consensus Kozak translation initiation site are cloned into pcDNA3.1/CT-GFP-TOPO (Invitrogen, Calif.). Protein expression is driven from the cytomegalovirus (CMV) promoter. The recombinant proteins have the Green Fluorescent Protein (GFP) fused to the carboxyl-terminus facilitating non-invasive, in vivo detection and cell biology studies. The pcDNA3.1CT-GFP-TOPO vector also contains the bovine growth hormone (BGH) polyadenylation signal and transcription termination sequence to enhance mRNA stability along with the SV40 origin for episomal replication and simple vector rescue in cell lines expressing the large T antigen. The Neomycin resistance gene allows for selection of mammalian cells that express the protein, and the ampicillin resistance gene and ColE1 origin permits selection and maintenance of the plasmid in *E. coli*. Additional constructs with an amino-terminal GFP fusion are made in pcDNA3.1/NT-GFP-TOPO spanning the entire length of a 282P1G3 protein.

PAPtag: A 282P1G3 ORF, or portions thereof, is cloned into pAPtag-5 (GenHunter Corp. Nashville, Tenn.). This construct generates an alkaline phosphatase fusion at the carboxyl-terminus of a 282P1G3 protein while fusing the IgGκ signal sequence to the amino-terminus. Constructs are also generated in which alkaline phosphatase with an amino-terminal IgGκ signal sequence is fused to the amino-terminus of a 282P1G3 protein. The resulting recombinant 282P1G3 proteins are optimized for secretion into the media of transfected mammalian cells and can be used to identify proteins such as ligands or receptors that interact with 282P1G3 proteins. Protein expression is driven from the CMV promoter and the recombinant proteins also contain myc and 6×His epitopes fused at the carboxyl-terminus that facilitates detection and purification. The Zeocin resistance gene present in the vector allows for selection of mammalian cells expressing the recombinant protein and the ampicillin resistance gene permits selection of the plasmid in *E. coli.* pTag5: A 282P1G3 ORF, or portions thereof, were cloned into pTag-5. This vector is similar to pAPtag but without the alkaline phosphatase fusion. This construct generates 282P1G3 protein with an amino-terminal IgGκ signal sequence and myc and 6×His epitope tags at the carboxyl-terminus that facilitate detection and affinity purification. The resulting recombinant 282P1G3 protein is optimized for secretion into the media of transfected mammalian cells, and is used as immunogen or ligand to identify proteins such as ligands or receptors that interact with the 282P1G3 proteins. Protein expression is driven from the CMV promoter. The Zeocin resistance gene present in the vector allows for selection of mammalian cells expressing the protein, and the ampicillin resistance gene permits selection of the plasmid in *E. coli.*

The extracellular domain, amino acids 26–1043, of 282P1G3 v.2 was cloned into the pTag5 construct to generate 282P1G3.pTag5. FIG. 20 shows expression and secretion of the extracellular domain of 282P1G3 following 282P1G3.pTag5 vector transfection into 293T cells. 293T cells were transfected with 282P1G3.pTag5 construct. Forty hours later, supernatant as well as cell lysates were collected. Samples were run on an SDS-PAGE acrylamide gel, blotted and stained with anti-his antibody. The blot was developed using the ECL chemiluminescence kit and visualized by autoradiography. Results show expression and secretion of 282P1G3 from the 282P1G3.pTag5 transfected cells.

PsecFc: A 282P1G3 ORF, or portions thereof, is also cloned into psecFc. The psecFc vector was assembled by cloning the human immunoglobulin G1 (IgG) Fc (hinge, CH2, CH3 regions) into pSecTag2 (Invitrogen, Calif.). This construct generates an IgG1 Fc fusion at the carboxyl-terminus of the 282P1G3 proteins, while fusing the IgGK signal sequence to N-terminus. 282P1G3 fusions utilizing the murine IgG1 Fc region are also used. The resulting recombinant 282P1G3 proteins are optimized for secretion into the media of transfected mammalian cells, and can be used as immunogens or to identify proteins such as ligands or receptors that interact with 282P1G3 protein. Protein expression is driven from the CMV promoter. The hygromycin resistance gene present in the vector allows for selection of mammalian cells that express the recombinant protein, and the ampicillin resistance gene permits selection of the plasmid in *E. coli.* pSRα Constructs: To generate mammalian cell lines that express 282P1G3 constitutively, 282P1G3 ORF, or portions thereof, of 282P1G3 were cloned into pSRα constructs. Amphotropic and ecotropic retroviruses were generated by transfection of pSRα constructs into the 293T-10A1 packaging line or co-transfection of pSRα and a helper plasmid (containing deleted packaging sequences) into the 293 cells, respectively. The retrovirus is used to infect a variety of mammalian cell lines, resulting in the integration of the cloned gene, 282P1G3, into the host cell-lines. Protein expression is driven from a long terminal repeat (LTR). The Neomycin resistance gene present in the vector allows for selection of mammalian cells that express the protein, and the ampicillin resistance gene and ColE1 origin permit selection and maintenance of the plasmid in *E. coli*. The retroviral vectors can thereafter be used for infection and generation of various cell lines using, for example, PC3, NIH 3T3, TsuPr1, 293 or rat-1 cells.

Additional pSRα constructs are made that fuse an epitope tag such as the FLAG™ tag to the carboxyl-terminus of 282P1G3 sequences to allow detection using anti-Flag antibodies. For example, the FLAG™ sequence 5' gat tac aag gat gac gac gat aag 3' (SEQ ID NO: 53) is added to cloning primer at the 3' end of the ORF. Additional pSRα constructs are made to produce both amino-terminal and carboxyl-terminal GFP and myc/6×His fusion proteins of the full-length 282P1G3 proteins.

Additional Viral Vectors: Additional constructs are made for viral-mediated delivery and expression of 282P1G3. High virus titer leading to high level expression of 282P1G3 is achieved in viral delivery systems such as adenoviral vectors and herpes amplicon vectors. A 282P1G3 coding sequences or fragments thereof are amplified by PCR and subcloned into the AdEasy shuttle vector (Stratagene). Recombination and virus packaging are performed according to the manufacturer's instructions to generate adenoviral vectors. Alternatively, 282P1G3 coding sequences or fragments thereof are cloned into the HSV-1 vector (Imgenex) to generate herpes viral vectors. The viral vectors are thereafter used for infection of various cell lines such as PC3, NIH 3T3, 293 or rat-1 cells.

Regulated Expression Systems: To control expression of 282P1G3 in mammalian cells, coding sequences of 282P1G3, or portions thereof, are cloned into regulated mammalian expression systems such as the T-Rex System (Invitrogen), the GeneSwitch System (Invitrogen) and the tightly-regulated Ecdysone System (Sratagene). These systems allow the study of the temporal and concentration dependent effects of recombinant 282P1G3. These vectors are thereafter used to control expression of 282P1G3 in various cell lines such as PC3, NIH 3T3, 293 or rat-1 cells.

B. Baculovirus Expression Systems

To generate recombinant 282P1G3 proteins in a baculovirus expression system, 282P1G3 ORF, or portions thereof, are cloned into the baculovirus transfer vector pBlueBac 4.5 (Invitrogen), which provides a His-tag at the N-terminus. Specifically, pBlueBac-282P1G3 is co-transfected with helper plasmid pBac-N-Blue (Invitrogen) into SF9 (*Spodoptera frugiperda*) insect cells to generate recombinant baculovirus (see Invitrogen instruction manual for details). Baculovirus is then collected from cell supernatant and purified by plaque assay.

Recombinant 282P1G3 protein is then generated by infection of HighFive insect cells (Invitrogen) with purified baculovirus. Recombinant 282P1G3 protein can be detected using anti-282P1G3 or anti-His-tag antibody. 282P1G3 protein can be purified and used in various cell-based assays or as immunogen to generate polyclonal and monoclonal antibodies specific for 282P1G3.

Example 9

Antigenicity Profiles and Secondary Structure

FIG. 5(A–C), FIG. 6(A–C), FIG. 7(A–C), FIG. 8(A–C), and FIG. 9(A–C) depict graphically five amino acid profiles of 282P1G3 variants 1, 3, and 7, each assessment available by accessing the ProtScale website located on the World Wide Web on the ExPasy molecular biology server.

These profiles: FIGS. 5(A–C), Hydrophilicity, (Hopp T. P., Woods K. R., 1981. Proc. Natl. Acad. Sci. U.S.A. 78:3824–3828); FIGS. 6(A–C), Hydropathicity, (Kyte J., Doolittle R. F., 1982. J. Mol. Biol. 157:105–132); FIGS. 7(A–C), Percentage Accessible Residues (Janin J., 1979 Nature 277:491–492); FIGS. 8(A–C), Average Flexibility, (Bhaskaran R., and Ponnuswamy P. K., 1988. Int. J. Pept. Protein Res. 32:242–255); FIGS. 9(A–C), Beta-turn (Deleage, G., Roux B. 1987 Protein Engineering 1:289–294); and optionally others available in the art, such as on the ProtScale website, were used to identify antigenic regions of each of the 282P1G3 variant proteins. Each of the above amino acid profiles of 282P1G3 variants were generated using the following ProtScale parameters for analysis: 1) A window size of 9; 2) 100% weight of the window edges compared to the window center; and, 3) amino acid profile values normalized to lie between 0 and 1.

Hydrophilicity (FIG. 5), Hydropathicity (FIG. 6) and Percentage Accessible Residues (FIG. 7) profiles were used to determine stretches of hydrophilic amino acids (i.e., values greater than 0.5 on the Hydrophilicity and Percentage Accessible Residues profile, and values less than 0.5 on the Hydropathicity profile). Such regions are likely to be exposed to the aqueous environment, be present on the surface of the protein, and thus available for immune recognition, such as by antibodies.

Average Flexibility (FIG. 8) and Beta-turn (FIG. 9) profiles determine stretches of amino acids (i.e., values greater than 0.5 on the Beta-turn profile and the Average Flexibility profile) that are not constrained in secondary structures such as beta sheets and alpha helices. Such regions are also more likely to be exposed on the protein and thus accessible to immune recognition, such as by antibodies.

Antigenic sequences of the 282P1G3 variant proteins indicated, e.g., by the profiles set forth in FIGS. 5(A–C), FIGS. 6(AA–C), FIGS. 7(A–C), FIGS. 8(A–C), and/or FIGS. 9(A–C) are used to prepare immunogens, either peptides or nucleic acids that encode them, to generate therapeutic and diagnostic anti-282P1G3 antibodies. The immunogen can be any 5, 6, 7, 8, 9, 10, 11, 12, 13, 14, 15, 16, 17, 18, 19, 20, 21, 22, 23, 24, 25, 30, 35, 40, 45, 50 or more than 50 contiguous amino acids, or the corresponding nucleic acids that encode them, from the 282P1G3 protein variants listed in FIGS. 2 and 3, In particular, peptide immunogens of the invention can comprise, a peptide region of at least 5 amino acids of FIGS. 2 and 3 in any whole number increment that includes an amino acid position having a value greater than 0.5 in the Hydrophilicity profiles of FIG. 5; a peptide region of at least 5 amino acids of FIGS. 2 and 3 in any whole number increment that includes an amino acid position having a value less than 0.5 in the Hydropathicity profile of FIGS. 6; a peptide region of at least 5 amino acids of FIGS. 2 and 3 in any whole number increment that includes an amino acid position having a value greater than 0.5 in the Percent Accessible Residues profiles of FIG. 7; a peptide region of at least 5 amino acids of FIGS. 2 and 3 in any whole number increment that includes an amino acid position having a value greater than 0.5 in the Average Flexibility profiles on FIG. 8; and, a peptide region of at least 5 amino acids of FIGS. 2 and 3 in any whole number increment that includes an amino acid position having a value greater than 0.5 in the Beta-turn profile of FIGS. 9. Peptide immunogens of the invention can also comprise nucleic acids that encode any of the forgoing.

All immunogens of the invention, peptide or nucleic acid, can be embodied in human unit dose form, or comprised by a composition that includes a pharmaceutical excipient compatible with human physiology.

The secondary structure of 282P1G3 protein variants 1 through 8, namely the predicted presence and location of alpha helices, extended strands, and random coils, is predicted from the primary amino acid sequence using the HNN—Hierarchical Neural Network method (Guermeur, 1997, accessed from the ExPasy molecular biology server located on the World Wide Web. The analysis indicates that 282P1G3 variant 1 is composed of 15.77% alpha helix, 26.14% extended strand, and 58.09% random coil (FIG. 13A). Variant 2 is composed of 14.86% alpha helix, 26.39% extended strand, and 58.75% random coil (FIG. 13B). Variant 3 is composed of 14.00% alpha helix, 29.34% extended strand, and 56.66% random coil (FIG. 13C). Variant 4 is composed of 15.94% alpha helix, 26.14% extended strand, and 57.92% random coil (FIG. 13D). Variant 5 is composed of 15.73% alpha helix, 26.32% extended strand, and 57.95% random coil (FIG. 13E). Variant 6 is composed of 16.99% alpha helix, 25.36% extended strand, and 57.65% random coil (FIG. 13F). Variant 7 is composed of 15.78% alpha helix, 26.13% extended strand, and 58.09% random coil (FIG. 13G). Variant 8 is composed of 16.99% alpha helix, 25.36% extended strand, and 57.66% random coil (FIG. 13H).

Figure 13I:
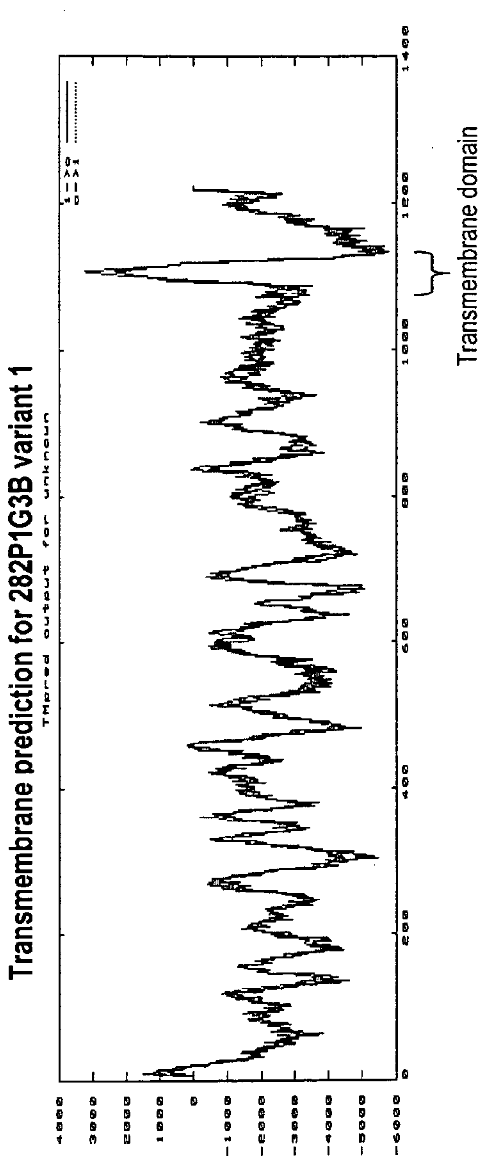
Figure 13J:
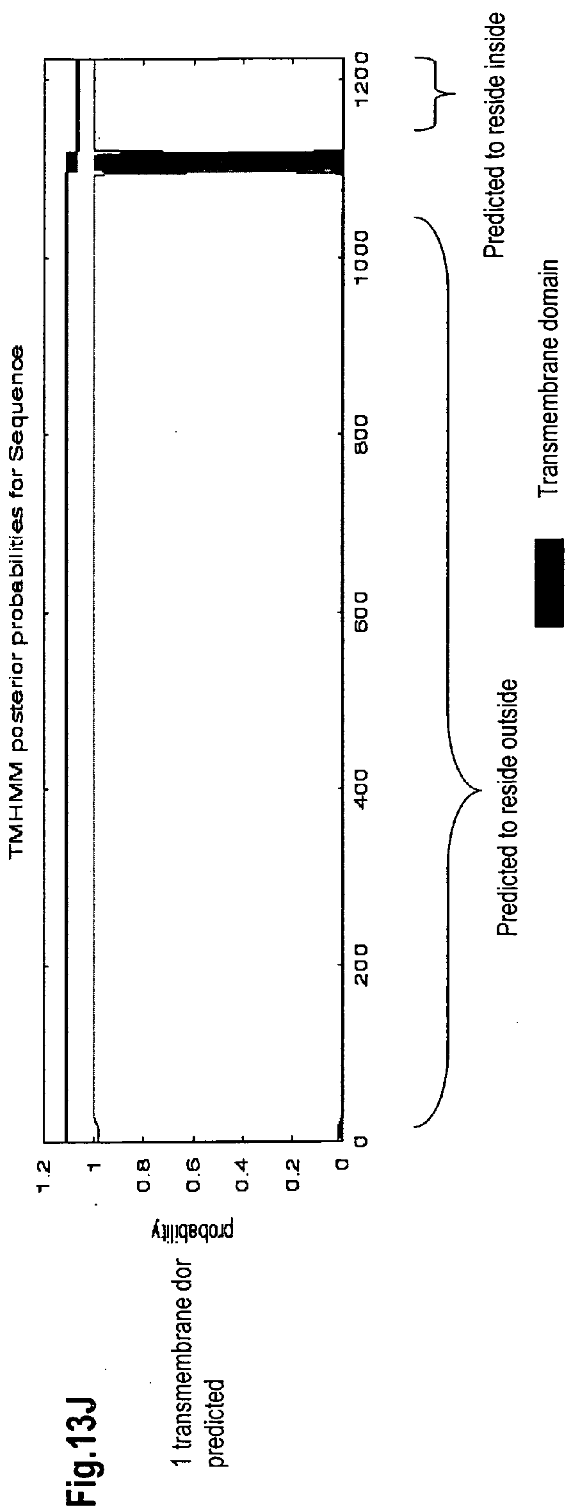
Figure 13K:
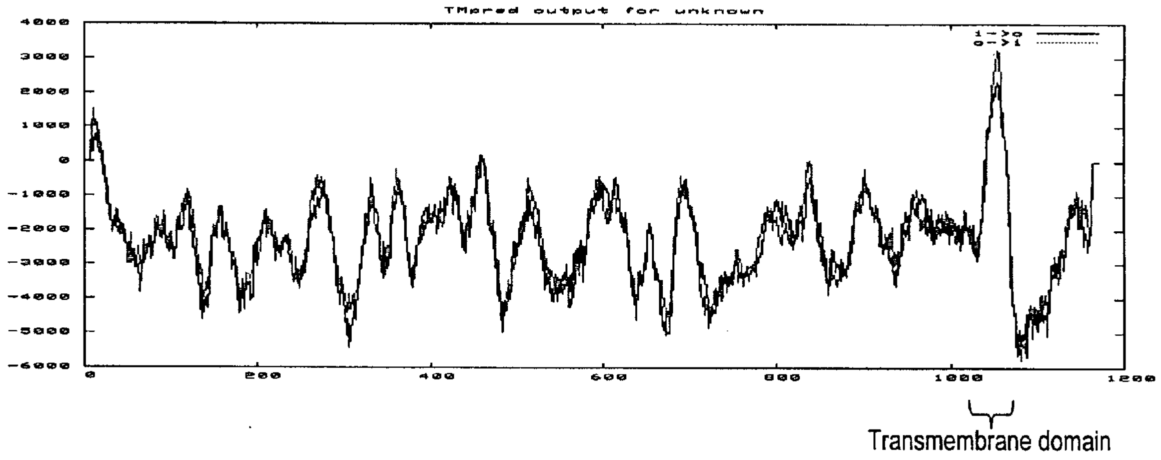
Figure 13L:
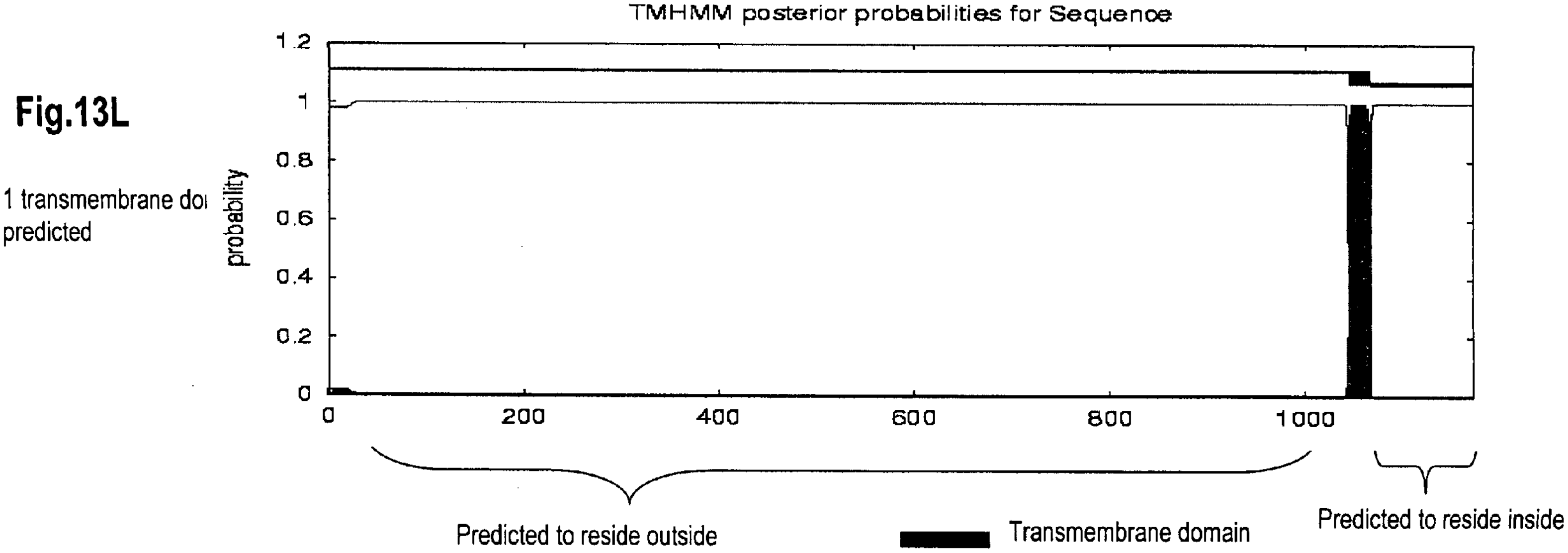
Figure 13M:
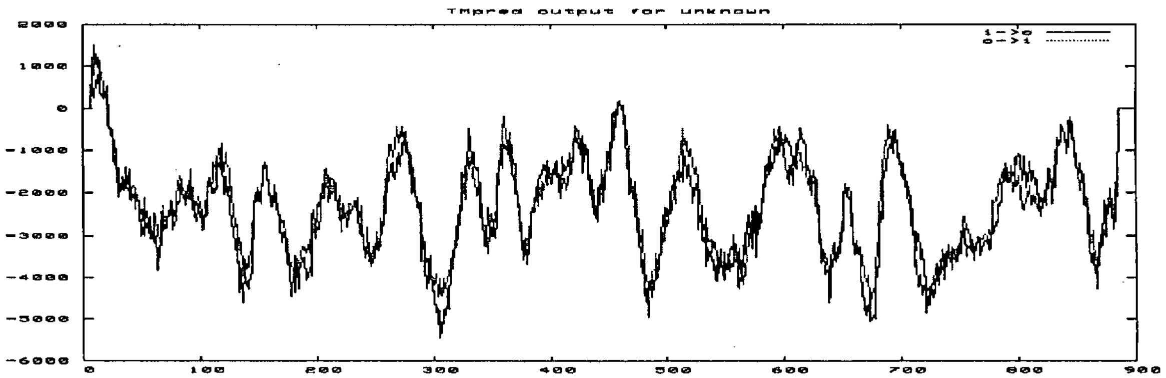
Figure 13N:
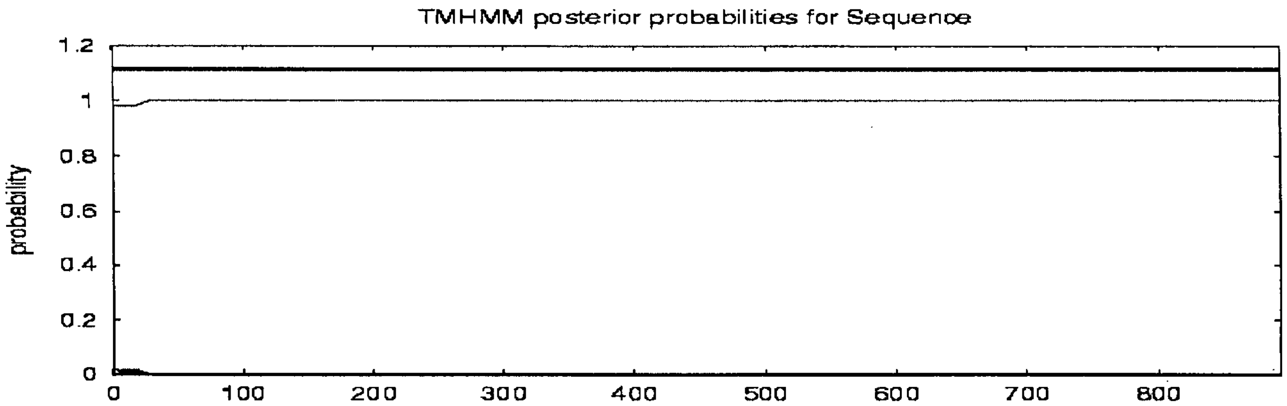
Figure 13O:
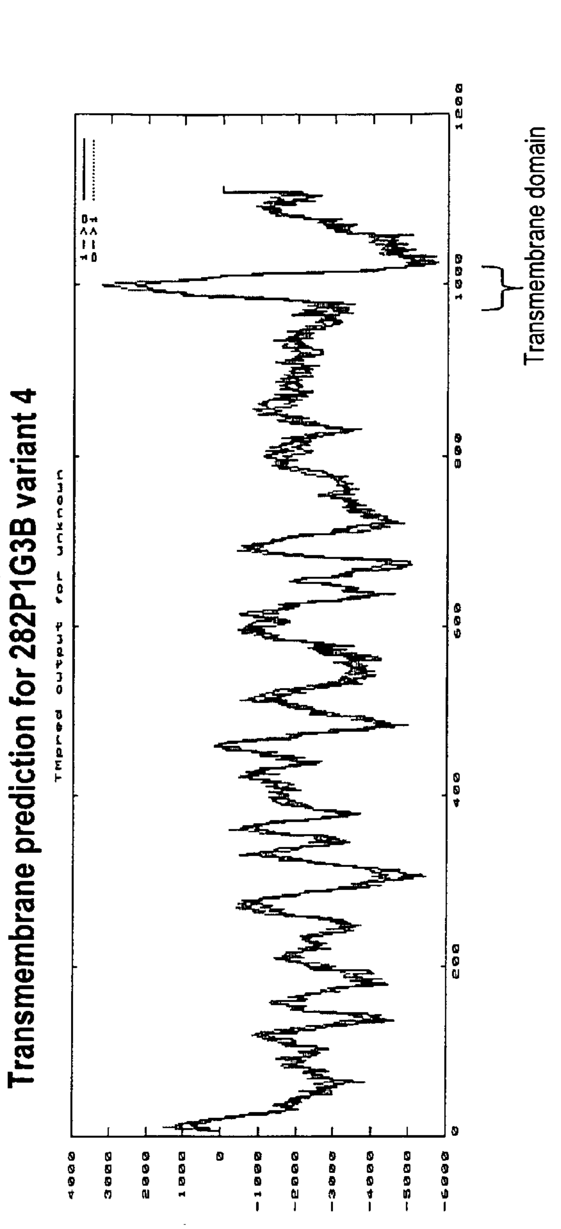
Figure 13P:
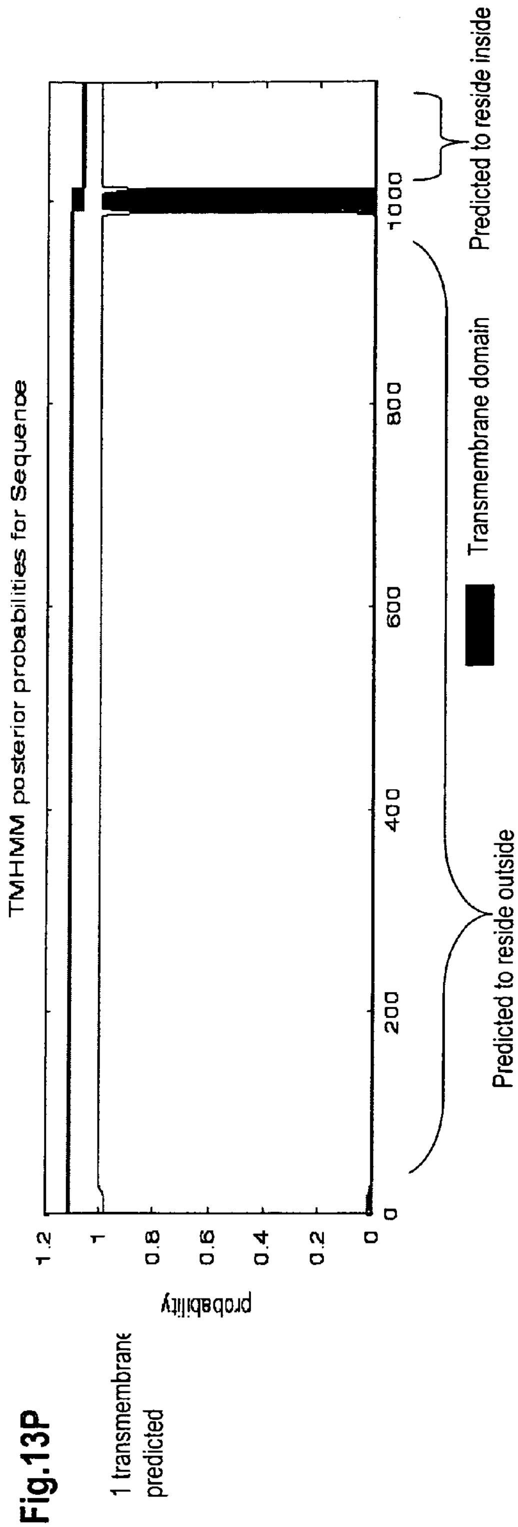
Figure 13Q:
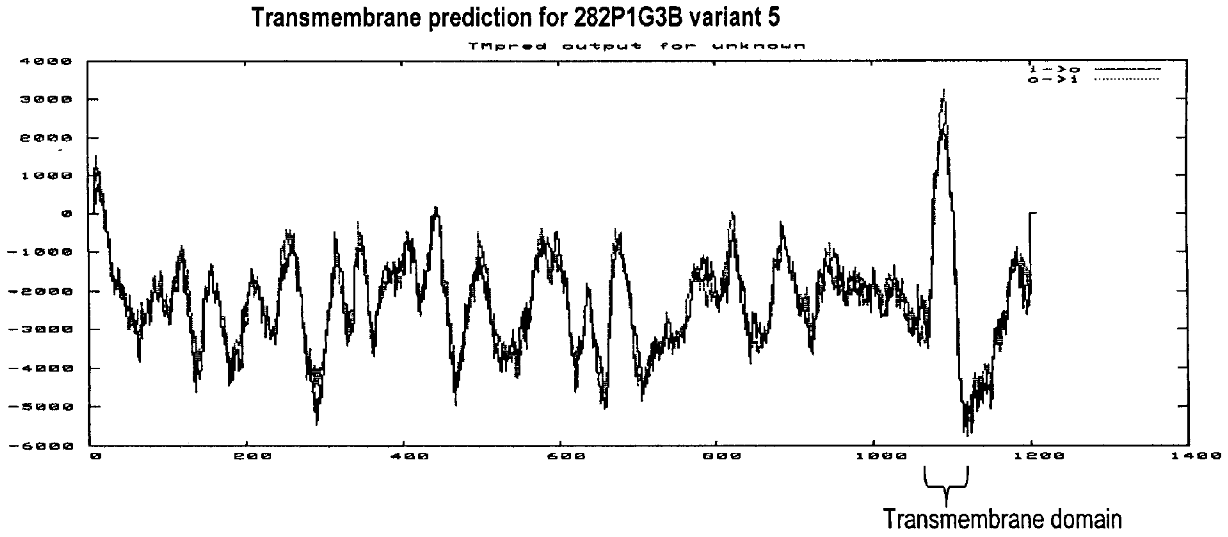
Figure 13R:
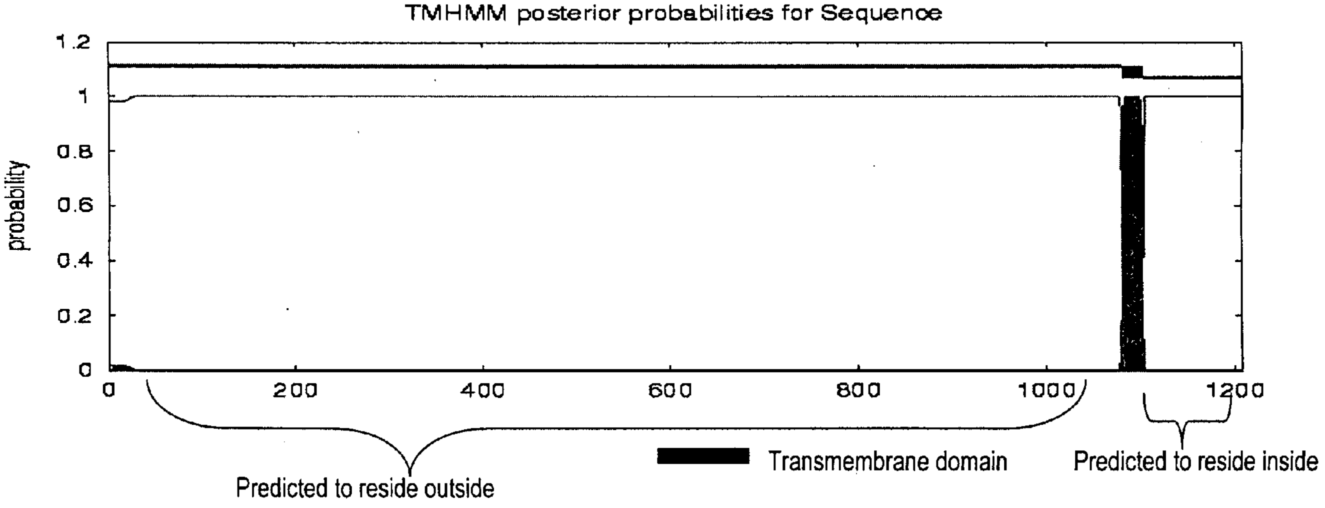
Figure 13S:
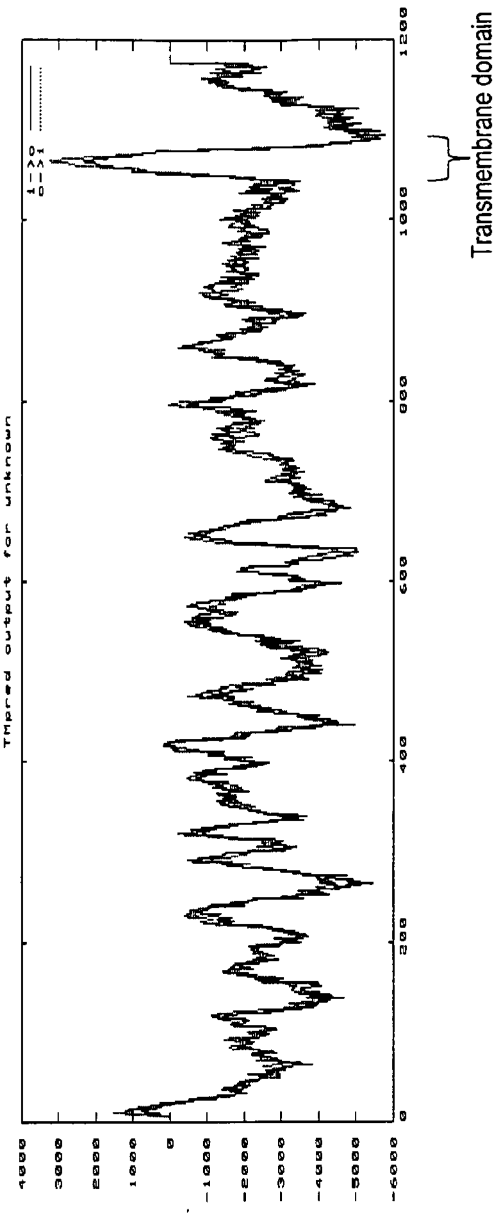
Figure 13T:
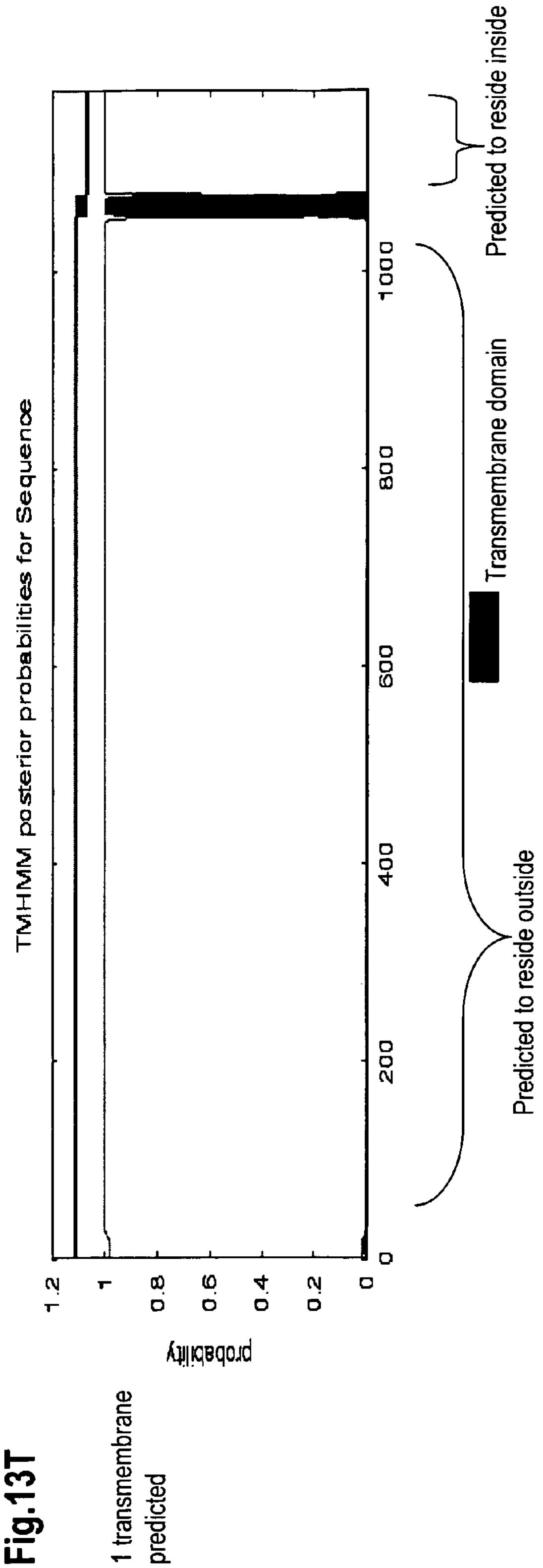
Figure 13U:
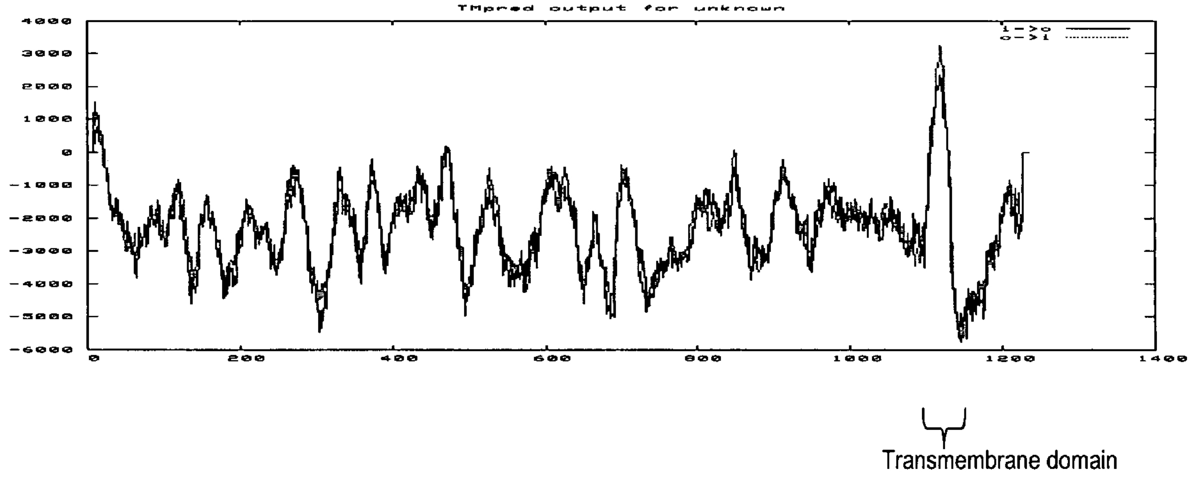
Figure 13V:
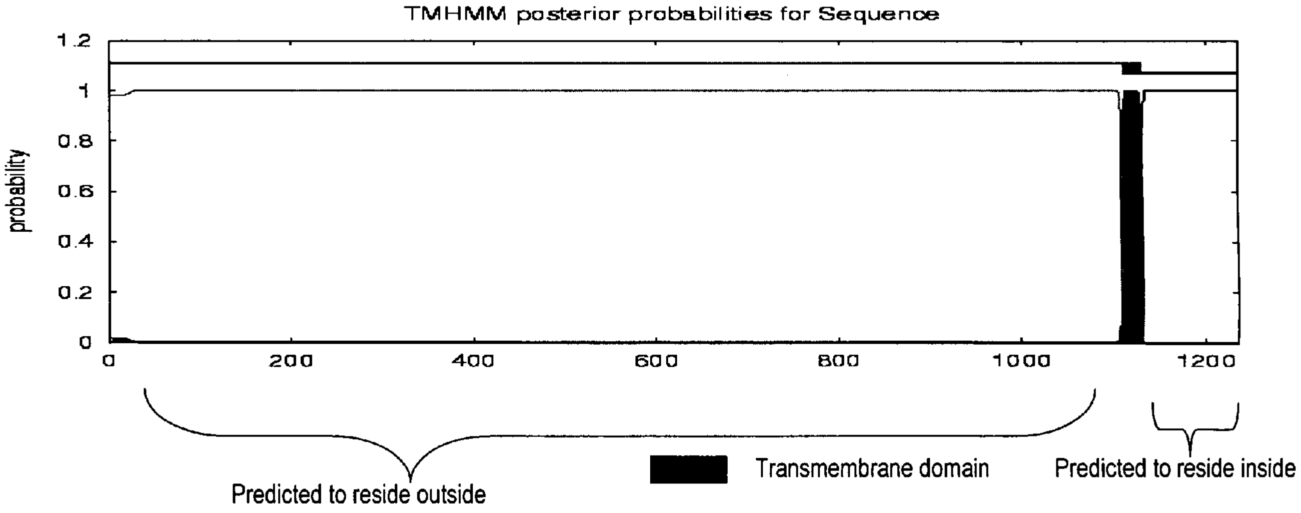
Figure 13W:
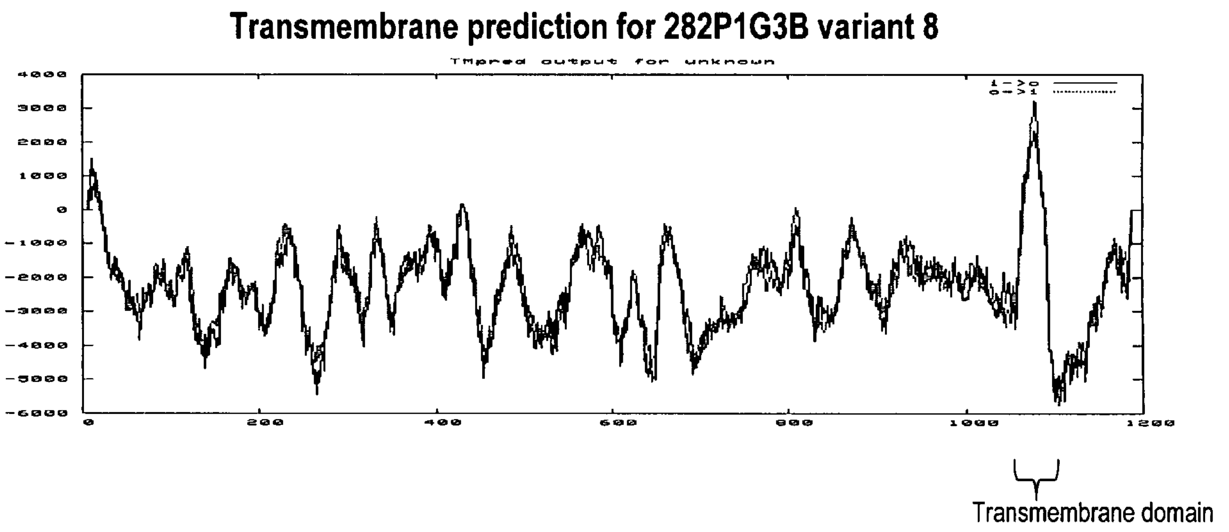
Figure 13X:
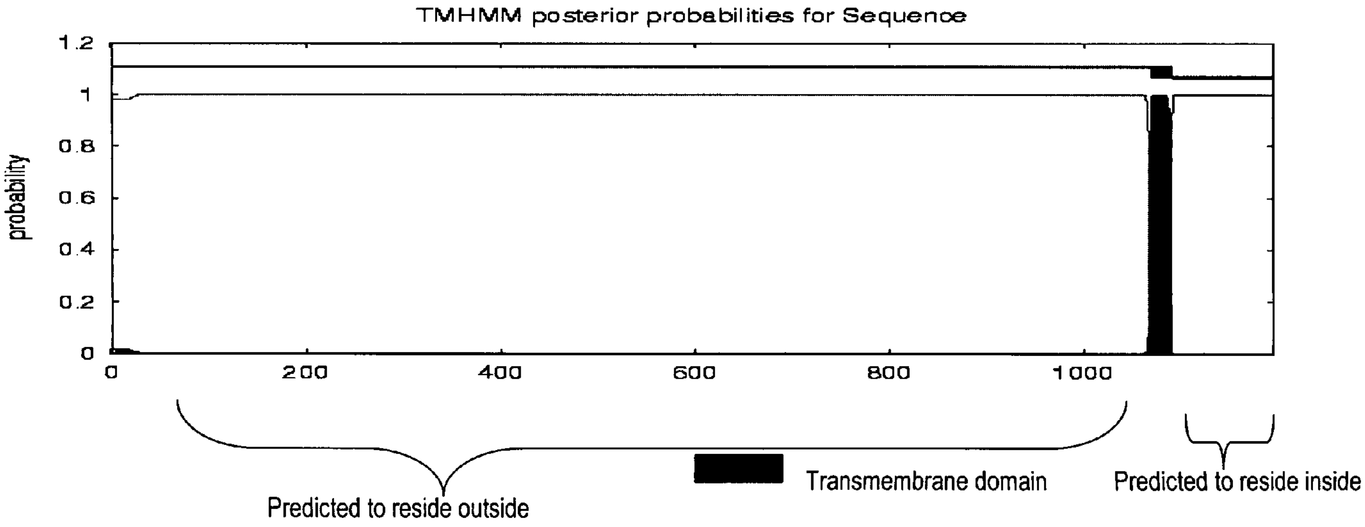

Analysis for the potential presence of transmembrane domains in the 282P1G3 variant proteins was carried out using a variety of transmembrane prediction algorithms accessed from the ExPasy molecular biology server located on the World Wide Web at Shown graphically in FIGS. 13I and 13J are the results of analysis of variant 1 depicting the presence and location of 1 transmembrane domain using the TMpred program (FIG. 13I) and 1 transmembrane domain using the TMHMM program (FIG. 13J). Shown graphically in FIGS. 13K and 13L are the results of analysis of variant 2 depicting the presence and location of 1 transmembrane domains using the TMpred program (FIG. 13K) and 1 transmembrane domain using the TMHMM program (FIG. 13L). Shown graphically in FIGS. 13M and 13N are the results of analysis of variant 3 depicting no transmembrane domain using both the TMpred program (FIG. 13M) and TMHMM program (FIG. 13N). Shown graphically in FIGS. 13O and 13P are the results of analysis of variant 4 depicting the presence and location of 1 transmembrane domain using the TMpred program (FIG. 13O) and 1 transmembrane domain using the TMHMM program (FIG. 13P). Shown graphically in FIGS. 13Q and 13R are the results of analysis of variant 5 depicting the presence and location of 1 transmembrane domain using the TMpred program (FIG. 13Q) and 1 transmembrane domain using the TMHMM program (FIG. 13R). Shown graphically in FIGS. 13S and 13T are the results of analysis of variant 6 depicting the presence and location of 1 transmembrane domain using the TMpred program (FIG. 13S) and 1 transmembrane domain using the TMHMM program (FIG. 13T). Shown graphically in FIGS. 13U and 13V are the results of analysis of variant 7 depicting the presence and location of 1 transmembrane domain using the TMpred program (FIG. 13U) and 1 transmembrane domain using the TMHMM program (FIG. 13V). Shown graphically in FIGS. 13W and 13X are the results of analysis of variant 8 depicting the presence and location of 1 transmembrane domain using the TMpred program (FIG. 13W) and 1 transmembrane domain using the TMHMM program (FIG. 13X). The results of each program, namely the amino acids encoding the transmembrane domains are summarized in Table VI.

Example 10

Generation of 282P1G3 Polyclonal Antibodies

Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. In addition to immunizing with a full length 282P1G3 protein variant, computer algorithms are employed in design of immunogens that, based on amino acid sequence analysis contain characteristics of being antigenic and available for recognition by the immune system of the immunized host (see the Example entitled "Antigenicity Profiles and Secondary Structure"). Such regions would be predicted to be hydrophilic, flexible, in beta-turn conformations, and be exposed on the surface of the protein (see, e.g., FIGS. 5(A–C), FIGS. 6(A & C), FIGS. 7(A–C), FIGS. 8(A–C), or FIGS. 9(A–C) for amino acid profiles that indicate such regions of 282P1G3 protein variants).

For example, recombinant bacterial fusion proteins or peptides containing hydrophilic, flexible, beta-turn regions of 282P1G3 protein variants are used as antigens to generate polyclonal antibodies in New Zealand White rabbits or monoclonal antibodies as described in Example 11. For example, in 282P1G3 variant 1, such regions include, but are not limited to, amino acids 57–75, amino acids 131–135, amino acids 210–265, amino acids 550–588, and amino acids 662–688. In sequence unique to variant 3, such regions include, but are not limited to, amino acids 855–872 and amino acids 856–886. In sequence specific for variant 7, such regions include, but are not limited to, amino acids 345–356. It is useful to conjugate the immunizing agent to a protein known to be immunogenic in the mammal being immunized. Examples of such immunogenic proteins include, but are not limited to, keyhole limpet hemocyanin (KLH), serum albumin, bovine thyroglobulin, and soybean trypsin inhibitor. In one embodiment, a peptide encoding amino acids 57–75 of 282P1G3 variant 1 was conjugated to KLH and used to immunize a rabbit. Alternatively the immunizing agent may include all or portions of the 282P1G3 variant proteins, analogs or fusion proteins thereof. For example, the 282P1G3 variant 1 amino acids sequence can be fused using recombinant DNA techniques to any one of a variety of fusion protein partners that are well known in the art, such as glutathione-S-transferase (GST) and HIS tagged fusion proteins. In another embodiment, amino acids 26–265 of 282P1G3 variant 1 was fused to GST using recombinant techniques and the pGEX expression vector, expressed, purified and used to immunize a rabbit. Such fusion proteins are purified from induced bacteria using the appropriate affinity matrix.

Other recombinant bacterial fusion proteins that may be employed include maltose binding protein, LacZ, thioredoxin, NusA, or an immunoglobulin constant region (see the section entitled "Production of 282P1G3 in Prokaryotic Systems" and Current Protocols In Molecular Biology, Volume 2, Unit 16, Frederick M. Ausubul et al. eds., 1995; Linsley, P. S., Brady, W., Urnes, M., Grosmaire, L., Damle, N., and Ledbetter, L.(1991) J.Exp. Med. 174, 561–566).

In addition to bacterial derived fusion proteins, mammalian expressed protein antigens are also used. These antigens are expressed from mammalian expression vectors such as the Tag5 and Fc-fusion vectors (see the section entitled "Production of Recombinant 282P1G3 in Eukaryotic Systems"), and retains post-translational modifications such as glycosylations found in native protein. In one embodiment, amino acids 26–1,043 of variant 2, encoding the extracellular domain, was cloned into the Tag5 mammalian secretion vector, and expressed in 293T cells. The recombinant protein is purified by metal chelate chromatography from tissue culture supernatants of 293T cells stably expressing the recombinant vector. The purified Tag5 282P1G3 protein is then used as immunogen.

During the immunization protocol, it is useful to mix or emulsify the antigen in adjuvants that enhance the immune response of the host animal. Examples of adjuvants include, but are not limited to, complete Freund's adjuvant (CFA) and MPL-TDM adjuvant (monophosphoryl Lipid A, synthetic trehalose dicorynomycolate).

In a typical protocol, rabbits are initially immunized subcutaneously with up to 200 μg, typically 100–200 μg, of fusion protein or peptide conjugated to KLH mixed in complete Freund's adjuvant (CFA). Rabbits are then injected subcutaneously every two weeks with up to 200 μg, typically 100–200 μg, of the immunogen in incomplete Freund's adjuvant (IFA). Test bleeds are taken approximately 7–10 days following each immunization and used to monitor the titer of the antiserum by ELISA.

To test reactivity and specificity of immune serum, such as the rabbit serum derived from immunization with the Tag5–282P1G3 variant 2 protein, the full-length 282P1G3 variant 1 cDNA is cloned into pCDNA 3.1 myc-his expression vector (Invitrogen, see the Example entitled "Production of Recombinant 282P1G3 in Eukaryotic Systems"). After transfection of the constructs into 293T cells, cell lysates are probed with the anti-282P1G3 serum and with anti-His atibody (See FIG. 19; Santa Cruz Biotechnologies, Santa Cruz, Calif.) to determine specific reactivity to denatured 282P1G3 protein using the Western blot technique. In addition, the immune serum is tested by fluorescence microscopy, flow cytometry and immunoprecipitation against 293T and other recombinant 282P1G3-expressing cells to determine specific recognition of native protein. Western blot, immunoprecipitation, fluorescent microscopy, and flow cytometric techniques using cells that endogenously express 282P1G3 are also carried out to test reactivity and specificity.

Anti-serum from rabbits immunized with 282P1G3 variant fusion proteins, such as GST and MBP fusion proteins, are purified by depletion of antibodies reactive to the fusion partner sequence by passage over an affinity column containing the fusion partner either alone or in the context of an irrelevant fusion protein. For example, antiserum derived from a GST-282P1G3 variant 1 fusion protein is first purified by passage over a column of GST protein covalently coupled to AffiGel matrix (BioRad, Hercules, Calif.). The antiserum is then affinity purified by passage over a column composed of a MBP-282P1G3 fusion protein covalently coupled to Affigel matrix. The serum is then further purified by protein G affinity chromatography to isolate the IgG fraction. Sera from other His-tagged antigens and peptide immunized rabbits as well as fusion partner depleted sera are affinity purified by passage over a column matrix composed of the original protein immunogen or free peptide.

Example 11

Generation of 282P1G3 Monoclonal Antibodies (mAbs)

In one embodiment, therapeutic mAbs to 282P1G3 variants comprise those that react with epitopes specific for each variant protein or specific to sequences in common between the variants that would disrupt or modulate the biological function of the 282P1G3 variants, for example those that would disrupt the interaction with ligands and binding partners. Immunogens for generation of such mAbs include those designed to encode or contain the entire 282P1G3 protein variant sequence, regions of the 282P1G3 protein variants predicted to be anfigenic from computer analysis of the amino acid sequence. (see, e.g., FIGS. 5(A–C), FIGS. 6(A–C), FIGS. 7(A–C), FIGS. 8(A–C), or FIGS. 9(A–C), and the Example entitled "Antigenicity Profiles and Secondary Structure"). Immunogens include peptides, recombinant bacterial proteins, and mammalian expressed Tag 5 proteins and human and murine IgG FC fusion proteins. In addition, cells engineered to express high levels of a respective 282P1G3 variant, such as 293T-282P1G3 variant 1 or 300.19-282P1G3 variant 1 murine Pre-B cells, are used to immunize mice.

To generate mAbs to a 282P1G3 variant, mice are first immunized intraperitoneally (IP) with, typically, 10–50 μg of protein immunogen or $10^7$ 282P1G3-expressing cells mixed in complete Freund's adjuvant. Mice are then subsequently immunized IP every 2–4 weeks with, typically, 10–50 μg of protein immunogen or $10^7$ cells mixed in incomplete Freund's adjuvant. Alternatively, MPL-TDM adjuvant is used in immunizations. In addition to the above protein and cell-based immunization strategies, a DNA-based immunization protocol is employed in which a mammalian expression vector encoding a 282P1G3 variant sequence is used to immunize mice by direct injection of the plasmid DNA. For example, amino acids 26–1,043 of variant 2 was cloned into the Tag5 mammalian secretion vector and the recombinant vector will then be used as immunogen. In another example the same amino acids are cloned into an Fc-fusion secretion vector in which the 282P1G3 variant 2 sequence is fused at the amino-terminus to an IgK leader sequence and at the carboxyl-terminus to the coding sequence of the human or murine IgG Fc region. This recombinant vector is then used as immunogen. The plasmid immunization protocols are used in combination with purified proteins expressed from the same vector and with cells expressing the respective 282P1G3 variant.

During the immunization protocol, test bleeds are taken 7–10 days following an injection to monitor titer and specificity of the immune response. Once appropriate reactivity and specificity is obtained as determined by ELISA, Western blotting, immunoprecipitation, fluorescence microscopy, and flow cytometric analyses, fusion and hybridoma generation is then carried out with established procedures well known in the art (see, e.g., Harlow and Lane, 1988).

In one embodiment for generating 282P1G3 monoclonal antibodies, a Tag5-282P1G3 variant 2 antigen encoding amino acids 26–1,043, was expressed (FIG. 20) and then purified from stably transfected 293T cells. Balb C mice are initially immunized intraperitoneally with 25 μg of the Tag5-282P1G3 variant 2 protein mixed in complete Freund's adjuvant. Mice are subsequently immunized every two weeks with 25 μg of the antigen mixed in incomplete Freund's adjuvant for a total of three immunizations. ELISA using the Tag5 antigen determines the titer of serum from immunized mice. Reactivity and specificity of serum to full length 282P1G3 variant 2 protein is monitored by Western blotting, immunoprecipitation and flow cytometry using 293T cells transfected with an expression vector encoding the 282P1G3 variant 2 cDNA (see e.g., the Example entitled "Production of Recombinant 282P1G3 in Eukaryotic Systems" and FIG. 19). Other recombinant 282P1G3 variant 2-expressing cells or cells endogenously expressing 282P1G3 variant 2 are also used. Mice showing the strongest reactivity are rested and given a final injection of Tag5 antigen in PBS and then sacrificed four days later. The spleens of the sacrificed mice are harvested and fused to SPO/2 myeloma cells using standard procedures (Harlow and Lane, 1988). Supernatants from HAT selected growth wells are screened by ELISA, Western blot, immunoprecipitation, fluorescent microscopy, and flow cytometry to identify 282P1G3 specific antibody-producing clones.

To generate monoclonal antibodies that are specific for each 282P 1 G3 variant protein, immunogens are designed to encode sequences unique for each variant. For example, peptides or recombinant protein antigens (i.e. Tag5 fusion proteins) encompassing the unique sequence derived from alternate exon usage in splice variants 2, 3, 4, 5, 6, and 7 are used as immunogens. In one embodiment, a Tag5 protein encoding amino acids 838–893 unique to 282P1G3 variant 3 is produced, purified, and used as immunogen to derive monoclonal antibodies specific to 282P1G3 variant 3. In another embodiment, an antigenic peptide composed of amino acids 1025–1037 of 282P1G3 variant 2 is coupled to KLH and used as immunogen. In another embodiment, an antigenic peptide composed of amino acids 817–829 of 282P1G3 variant 4 is coupled to KLH and used as immunogen. In another embodiment, an antigenic peptide composed of amino acids 220–232 of 282P1G3 variant 5 is coupled to KLH and used as immunogen. In another embodiment, an antigenic peptide composed of amino acids 122–134 of 282P1G3 variant 6 is coupled to KLH and used as immunogen. In another embodiment, an antigenic peptide composed of amino acids 339–362 of 282P1G3 variant 7 is coupled to KLH and used as immunogen. Hybridoma supernatants are then screened on the respective antigen and then further screened on cells expressing the specific variant and cross-screened on cells expressing the other variants to derive variant-specific monoclonal antibodies.

The binding affinity of a 282P1G3 variant monoclonal antibody is determined using standard technologies. Affinity measurements quantify the strength of antibody to epitope binding and are used to help define which 282P1G3 variant monoclonal antibodies preferred for diagnostic or therapeutic use, as appreciated by one of skill in the art. The BIAcore system (Uppsala, Sweden) is a preferred method for determining binding affinity. The BIAcore system uses surface plasmon resonance (SPR, Welford K. 1991, Opt. Quant. Elect. 23:1; Morton and Myszka, 1998, Methods in Enzymology 295: 268) to monitor biomolecular interactions in real time. BIAcore analysis conveniently generates association rate constants, dissociation rate constants, equilibrium dissociation constants, and affinity constants.

Example 12

HLA Class I and Class II Binding Assays

HLA class I and class II binding assays using purified HLA molecules are performed in accordance with disclosed protocols (e.g., PCT publications WO 94/20127 and WO 94/03205; Sidney et al., *Current Protocols in Immunology* 18.3.1 (1998); Sidney, et al., *J. Immunol.* 154:247 (1995); Sette, et al., *Mol. Immunol.* 31:813 (1994)). Briefly, purified MHC molecules (5 to 500 nM) are incubated with various unlabeled peptide inhibitors and 1–10 nM $^{125}$I-radiolabeled probe peptides as described. Following incubation, MHC-peptide complexes are separated from free peptide by gel filtration and the fraction of peptide bound is determined. Typically, in preliminary experiments, each MHC preparation is titered in the presence of fixed amounts of radiolabeled peptides to determine the concentration of HLA molecules necessary to bind 10–20% of the total radioactivity. All subsequent inhibition and direct binding assays are performed using these HLA concentrations.

Since under these conditions [label]<[HLA] and $IC_{50} \geqq$ [HLA], the measured $IC_{50}$ values are reasonable approximations of the true $K_D$ values. Peptide inhibitors are typically tested at concentrations ranging from 120 μg/ml to 1.2 ng/ml, and are tested in two to four completely independent experiments. To allow comparison of the data obtained in different experiments, a relative binding figure is calculated for each peptide by dividing the $IC_{50}$ of a positive control for inhibition by the $IC_{50}$ for each tested peptide (typically unlabeled versions of the radiolabeled probe peptide). For database purposes, and inter-experiment comparisons, relative binding values are compiled. These values can subsequently be converted back into $IC_{50}$ nM values by dividing the $IC_{50}$ nM of the positive controls for inhibition by the relative binding of the peptide of interest. This method of data compilation is accurate and consistent for comparing peptides that have been tested on different days, or with different lots of purified MHC.

Binding assays as outlined above may be used to analyze HLA supermotif and/or HLA motif-bearing peptides (see Table IV).

Example 13

Identification of HLA Supermotif- and Motif-Bearing CTL Candidate Epitopes

HLA vaccine compositions of the invention can include multiple epitopes. The multiple epitopes can comprise multiple HLA supermotifs or motifs to achieve broad population coverage. This example illustrates the identification and confirmation of supermotif- and motif-bearing epitopes for the inclusion in such a vaccine composition. Calculation of population coverage is performed using the strategy described below.

Computer Searches and Algorithms for Identification of Supermotif and/or Motif-bearing Epitopes The searches performed to identify the motif-bearing peptide sequences in the Example entitled "Antigenicity Profiles" and Tables VIII–XXI and XXII–XLIX employ the protein sequence data from the gene product of 282P1G3 set forth in FIGS. 2 and 3, the specific search peptides used to generate the tables are listed in Table VII.

Computer searches for epitopes bearing HLA Class I or Class II supermotifs or motifs are performed as follows. All translated 282P1G3 protein sequences are analyzed using a text string search software program to identify potential peptide sequences containing appropriate HLA binding motifs; such programs are readily produced in accordance with information in the art in view of known motif/supermotif disclosures. Furthermore, such calculations can be made mentally.

Identified A2-, A3-, and DR-supermotif sequences are scored using polynomial algorithms to predict their capacity to bind to specific HLA-Class I or Class II molecules. These polynomial algorithms account for the impact of different amino acids at different positions, and are essentially based on the premise that the overall affinity (or ΔG) of peptide-HLA molecule interactions can be approximated as a linear polynomial function of the type:

$$\text{“}\Delta G\text{”}=a_{1i}\times a_{2i}\times a_{3i}\ldots\times a_{ni}$$

where $a_{ji}$ is a coefficient which represents the effect of the presence of a given amino acid (j) at a given position (i) along the sequence of a peptide of n amino acids. The crucial assumption of this method is that the effects at each position are essentially independent of each other (i.e., independent binding of individual side-chains). When residue j occurs at position i in the peptide, it is assumed to contribute a constant amount $j_i$ to the free energy of binding of the peptide irrespective of the sequence of the rest of the peptide.

The method of derivation of specific algorithm coefficients has been described in Gulukota et al., *J. Mol. Biol.* 267:1258–126, 1997; (see also Sidney et al., *Human Immunol.* 45:79–93, 1996; and Southwood et al., *J. Immunol.* 160:3363–3373, 1998). Briefly, for all i positions, anchor and non-anchor alike, the geometric mean of the average relative binding (ARB) of all peptides carrying j is calculated relative to the remainder of the group, and used as the estimate of $j_i$. For Class II peptides, if multiple alignments are possible, only the highest scoring alignment is utilized, following an iterative procedure. To calculate an algorithm score of a given peptide in a test set, the ARB values corresponding to the sequence of the peptide are multiplied. If this product exceeds a chosen threshold, the peptide is predicted to bind. Appropriate thresholds are chosen as a function of the degree of stringency of prediction desired.

Selection of HLA-A2 Supertype Cross-reactive Peptides

Protein sequences from 282P1G3 are scanned utilizing motif identification software, to identify 8-, 9- 10- and 11-mer sequences containing the HLA-A2-supermotif main anchor specificity. Typically, these sequences are then scored using the protocol described above and the peptides corresponding to the positive-scoring sequences are synthesized and tested for their capacity to bind purified HLA-A*0201 molecules in vitro (HLA-A*0201 is considered a prototype A2 supertype molecule).

These peptides are then tested for the capacity to bind to additional A2-supertype molecules (A*0202, A*0203, A*0206, and A*6802). Peptides that bind to at least three of the five A2-supertype alleles tested are typically deemed A2-supertype cross-reactive binders. Preferred peptides bind at an affinity equal to or less than 500 nM to three or more HLA-A2 supertype molecules.

Selection of HLA-A3 Supermotif-bearing Epitopes

The 282P1G3 protein sequence(s) scanned above is also examined for the presence of peptides with the HLA-A3-supermotif primary anchors. Peptides corresponding to the HLA A3 supermotif-bearing sequences are then synthesized and tested for binding to HLA-A*0301 and HLA-A*1101 molecules, the molecules encoded by the two most prevalent A3-supertype alleles. The peptides that bind at least one of the two alleles with binding affinities of ≦500 nM, often ≦200 nM, are then tested for binding cross-reactivity to the other common A3-supertype alleles (e.g., A*3101, A*3301, and A*6801) to identify those that can bind at least three of the five HLA-A3-supertype molecules tested.

Selection of HLA-B7 Supermotif Bearing Epitopes

The 282P1G3 protein(s) scanned above is also analyzed for the presence of 8-, 9- 10-, or 11-mer peptides with the HLA-B7-supermotif. Corresponding peptides are synthesized and tested for binding to HLA-B*0702, the molecule encoded by the most common B7-supertype allele (i.e., the prototype B7 supertype allele). Peptides binding B*0702 with $IC_{50}$ of ≦500 nM are identified using standard methods. These peptides are then tested for binding to other common B7-supertype molecules (e.g., B*3501, B*5101, B*5301, and B*5401). Peptides capable of binding to three or more of the five B7-supertype alleles tested are thereby identified.

Selection of A1 and A24 Motif-bearing Epitopes

To further increase population coverage, HLA-A1 and -A24 epitopes can also be incorporated into vaccine compositions. An analysis of the 282P1G3 protein can also be performed to identify HLA-A1- and A24-motif-containing sequences.

High affinity and/or cross-reactive binding epitopes that bear other motif and/or supermotifs are identified using analogous methodology.

Example 14

Confirmation of Immunogenicity

Cross-reactive candidate CTL A2-supermotif-bearing peptides that are identified as described herein are selected to confirm in vitro immunogenicity. Confirmation is performed using the following methodology:

Target Cell Lines for Cellular Screening:

The .221A2.1 cell line, produced by transferring the HLA-A2.1 gene into the HLA-A, -B, -C null mutant human B-lymphoblastoid cell line 721.221, is used as the peptide-loaded target to measure activity of HLA-A2.1-restricted CTL. This cell line is grown in RPMI-1640 medium supplemented with antibiotics, sodium pyruvate, nonessential amino acids and 10% (v/v) heat inactivated FCS. Cells that express an antigen of interest, or transfectants comprising the gene encoding the antigen of interest, can be used as target cells to confirm the ability of peptide-specific CTLs to recognize endogenous antigen.

Primary CTL Induction Cultures:

Generation of Dendritic Cells (DC): PBMCs are thawed in RPMI with 30 μg/ml DNAse, washed twice and resuspended in complete medium (RPMI-1640 plus 5% AB human serum, non-essential amino acids, sodium pyruvate, L-glutamine and penicillin/streptomycin). The monocytes are purified by plating $10\times10^6$ PBMC/well in a 6-well plate. After 2 hours at 37° C., the non-adherent cells are removed by gently shaking the plates and aspirating the supernatants. The wells are washed a total of three times with 3 ml RPMI to remove most of the non-adherent and loosely adherent cells. Three ml of complete medium containing 50 ng/ml of GM-CSF and 1,000 U/ml of IL-4 are then added to each well. TNFα is added to the DCs on day 6 at 75 ng/ml and the cells are used for CTL induction cultures on day 7.

Induction of CTL with DC and Peptide: CD8+ T-cells are isolated by positive selection with Dynal immunomagnetic beads (Dynabeads® M-450) and the detacha-bead® reagent. Typically about 200–$250\times10^6$ PBMC are processed to obtain $24\times10^6$ CD8+ T-cells (enough for a 48-well plate culture). Briefly, the PBMCs are thawed in RPMI with 30 μg/ml DNAse, washed once with PBS containing 1% human AB serum and resuspended in PBS/1% AB serum at a concentration of $20\times10^6$ cells/ml. The magnetic beads are washed 3 times with PBS/AB serum, added to the cells (140 μl beads/$20\times10^6$ cells) and incubated for 1 hour at 4° C. with continuous mixing. The beads and cells are washed 4× with PBS/AB serum to remove the nonadherent cells and resuspended at $100\times10^6$ cells/ml (based on the original cell number) in PBS/AB serum containing 100 μl/ml detacha-bead® reagent and 30 μg/ml DNAse. The mixture is incubated for 1 hour at room temperature with continuous mixing. The beads are washed again with PBS/AB/DNAse to collect the CD8+ T-cells. The DC are collected and centrifuged at 1300 rpm for 5–7 minutes, washed once with PBS with 1% BSA, counted and pulsed with 40 μg/ml of peptide at a cell concentration of 1–$2\times10^6$/ml in the presence of 3 μg/ml $\beta_2$-microglobulin for 4 hours at 20° C. The DC are then irradiated (4,200 rads), washed 1 time with medium and counted again.

Setting up induction cultures: 0.25 ml cytokine-generated DC (at $1\times10^5$ cells/ml) are co-cultured with 0.25 ml of CD8+ T-cells (at $2\times10^6$ cell/ml) in each well of a 48-well plate in the presence of 10 ng/ml of IL-7. Recombinant human IL-10 is added the next day at a final concentration of 10 ng/ml and rhuman IL-2 is added 48 hours later at 10 IU/ml.

Restimulation of the induction cultures with peptide-pulsed adherent cells: Seven and fourteen days after the primary induction, the cells are restimulated with peptide-pulsed adherent cells. The PBMCs are thawed and washed twice with RPMI and DNAse. The cells are resuspended at $5\times10^6$ cells/ml and irradiated at ~4200 rads. The PBMCs are plated at $2\times10^6$ in 0.5 ml complete medium per well and incubated for 2 hours at 37° C. The plates are washed twice with RPMI by tapping the plate gently to remove the nonadherent cells and the adherent cells pulsed with 10 μg/ml of peptide in the presence of 3 μg/ml $\beta_2$ microglobulin in 0.25 ml RPMI/5% AB per well for 2 hours at 37° C. Peptide solution from each well is aspirated and the wells are washed once with RPMI. Most of the media is aspirated from the induction cultures (CD8+ cells) and brought to 0.5 ml with fresh media. The cells are then transferred to the wells containing the peptide-pulsed adherent cells. Twenty four hours later recombinant human IL-10 is added at a final concentration of 10 ng/ml and recombinant human IL2 is added the next day and again 2–3 days later at 50 IU/ml (Tsai et al., *Critical Reviews in Immunology* 18(1–2):65–75, 1998). Seven days later, the cultures are assayed for CTL activity in a $^{51}Cr$ release assay. In some experiments the cultures are assayed for peptide-specific recognition in the in situ IFNγ ELISA at the time of the second restimulation followed by assay of endogenous recognition 7 days later. After expansion, activity is measured in both assays for a side-by-side comparison.

Measurement of CTL Lytic Activity by $^{51}Cr$ Release.

Seven days after the second restimulation, cytotoxicity is determined in a standard (5 hr) $^{51}Cr$ release assay by assaying individual wells at a single E:T. Peptide-pulsed targets are prepared by incubating the cells with 10 μg/ml peptide overnight at 37° C.

Adherent target cells are removed from culture flasks with trypsin-EDTA. Target cells are labeled with 200 μCi of $^{51}Cr$ sodium chromate (Dupont, Wilmington, Del.) for 1 hour at 37° C. Labeled target cells are resuspended at $10^6$ per ml and diluted 1:10 with K562 cells at a concentration of $3.3\times10^6$ /ml (an NK-sensitive erythroblastoma cell line used to reduce non-specific lysis). Target cells (100 μl) and effectors (100 μl) are plated in 96 well round-bottom plates and incubated for 5 hours at 37° C. At that time, 100 μl of supernatant are collected from each well and percent lysis is determined according to the formula:

[(cpm of the test sample-cpm of the spontaneous $^{51}Cr$ release sample)/(cpm of the maximal $^{51}Cr$ release sample-cpm of the spontaneous $^{51}Cr$ release sample)]×100.

Maximum and spontaneous release are determined by incubating the labeled targets with 1% Triton X-100 and media alone, respectively. A positive culture is defined as one in which the specific lysis (sample-background) is 10% or higher in the case of individual wells and is 15% or more at the two highest E:T ratios when expanded cultures are assayed.

In Situ Measurement of Human IFNγ Production as an Indicator of Peptide-Specific and Endogenous Recognition Immulon 2 plates are coated with mouse anti-human IFNγ monoclonal antibody (4 μg/ml 0.1M $NaHCO_3$, pH8.2) overnight at 4° C. The plates are washed with $Ca^{2+}$, $Mg^{2+}$-free PBS/0.05% Tween 20 and blocked with PBS/10% FCS for two hours, after which the CTLs (100 μl/well) and targets (100 μl/well) are added to each well, leaving empty wells for the standards and blanks (which received media only). The target cells, either peptide-pulsed or endogenous targets, are used at a concentration of $1\times10^6$ cells/ml. The plates are incubated for 48 hours at 37° C. with 5% $CO_2$.

Recombinant human IFN-gamma is added to the standard wells starting at 400 pg or 1200 pg/100 microliter/well and the plate incubated for two hours at 37° C. The plates are washed and 100 μl of biotinylated mouse anti-human IFN-gamma monoclonal antibody (2 microgram/ml in PBS/3% FCS/0.05% Tween 20) are added and incubated for 2 hours at room temperature. After washing again, 100 microliter HRP-streptavidin (1:4000) are added and the plates incubated for one hour at room temperature. The plates are then washed 6× with wash buffer, 100 microliter/well developing solution (TMB 1:1) are added, and the plates allowed to develop for 5–15 minutes. The reaction is stopped with 50 microliter/well 1M $H_3PO_4$ and read at OD450. A culture is considered positive if it measured at least 50 pg of IFN-gamma/well above background and is twice the background level of expression.

CTL Expansion.

Those cultures that demonstrate specific lytic activity against peptide-pulsed targets and/or tumor targets are expanded over a two week period with anti-CD3. Briefly, $5\times10^4$ CD8+ cells are added to a T25 flask containing the following: $1\times10^6$ irradiated (4,200 rad) PBMC (autologous or allogeneic) per ml, $2\times10^5$ irradiated (8,000 rad) EBV-transformed cells per ml, and OKT3 (anti-CD3) at 30 ng per ml in RPMI-1640 containing 10% (v/v) human AB serum, non-essential amino acids, sodium pyruvate, 25 μM 2-mercaptoethanol, L-glutamine and penicillin/streptomycin. Recombinant human IL2 is added 24 hours later at a final concentration of 200 IU/ml and every three days thereafter with fresh media at 50 IU/ml. The cells are split if the cell concentration exceeds $1\times10^6$/ml and the cultures are assayed between days 13 and 15 at E:T ratios of 30, 10, 3 and 1:1 in the $^{51}$Cr release assay or at $1\times10^6$/ml in the in situ IFNγ assay using the same targets as before the expansion.

Cultures are expanded in the absence of anti-CD3+ as follows. Those cultures that demonstrate specific lytic activity against peptide and endogenous targets are selected and $5\times10^4$ CD8+ cells are added to a T25 flask containing the following: $1\times10^6$ autologous PBMC per ml which have been peptide-pulsed with 10 μg/ml peptide for two hours at 37° C. and irradiated (4,200 rad); $2\times10^5$ irradiated (8,000 rad) EBV-transformed cells per ml RPMI-1640 containing 10% (v/v) human AB serum, non-essential AA, sodium pyruvate, 25 mM 2-ME, L-glutamine and gentamicin.

Immunogenicity of A2 Supermotif-bearing Peptides

A2-supermotif cross-reactive binding peptides are tested in the cellular assay for the ability to induce peptide-specific CTL in normal individuals. In this analysis, a peptide is typically considered to be an epitope if it induces peptide-specific CTLs in at least individuals, and preferably, also recognizes the endogenously expressed peptide.

Immunogenicity can also be confirmed using PBMCs isolated from patients bearing a tumor that expresses 282P1G3. Briefly, PBMCs are isolated from patients, re-stimulated with peptide-pulsed monocytes and assayed for the ability to recognize peptide-pulsed target cells as well as transfected cells endogenously expressing the antigen.

Evaluation of A*03/A11 Immunogenicity

HLA-A3 supermotif-bearing cross-reactive binding peptides are also evaluated for immunogenicity using methodology analogous for that used to evaluate the immunogenicity of the HLA-A2 supermotif peptides.

Evaluation of B7 Immunogenicity.

Immunogenicity screening of the B7-supertype cross-reactive binding peptides identified as set forth herein are confirmed in a manner analogous to the confirmation of A2- and A3-supermotif-bearing peptides.

Peptides bearing other supermotifs/motifs, e.g., HLA-A1, HLA-A24 etc. are also confirmed using similar methodology

Example 15

Implementation of the Extended Supermotif to Improve the Binding Capacity of Native Epitopes by Creating Analogs HLA motifs and supermotifs (comprising primary and/or secondary residues) are useful in the identification and preparation of highly cross-reactive native peptides, as demonstrated herein. Moreover, the definition of HLA motifs and supermotifs also allows one to engineer highly cross-reactive epitopes by identifying residues within a native peptide sequence which can be analoged to confer upon the peptide certain characteristics, e.g. greater cross-reactivity within the group of HLA molecules that comprise a supertype, and/or greater binding affinity for some or all of those HLA molecules. Examples of analoging peptides to exhibit modulated binding affinity are set forth in this example.

Analoging at Primary Anchor Residues

Peptide engineering strategies are implemented to further increase the cross-reactivity of the epitopes. For example, the main anchors of A2-supermotif-bearing peptides are altered, for example, to introduce a preferred L, I, V, or M at position 2, and I or V at the C-terminus.

To analyze the cross-reactivity of the analog peptides, each engineered analog is initially tested for binding to the prototype A2 supertype allele A*0201, then, if A*0201 binding capacity is maintained, for A2-supertype cross-reactivity.

Alternatively, a peptide is confirmed as binding one or all supertype members and then analoged to modulate binding affinity to any one (or more) of the supertype members to add population coverage.

The selection of analogs for immunogenicity in a cellular screening analysis is typically further restricted by the capacity of the parent wild type (WT) peptide to bind at least weakly, i.e., bind at an $IC_{50}$ of 5000 nM or less, to three of more A2 supertype alleles. The rationale for this requirement is that the WT peptides must be present endogenously in sufficient quantity to be biologically relevant. Analoged peptides have been shown to have increased immunogenicity and cross-reactivity by T cells specific for the parent epitope (see, e.g., Parkhurst et al., *J. Immunol.* 157:2539, 1996; and Pogue et al., *Proc. Natl. Acad. Sci. USA* 92:8166, 1995).

In the cellular screening of these peptide analogs, it is important to confirm that analog-specific CTLs are also able to recognize the wild-type peptide and, when possible, target cells that endogenously express the epitope.

Analoging of HLA-A3 and B7-Supermotif-Bearing Peptides

Analogs of HLA-A3 supermotif-bearing epitopes are generated using strategies similar to those employed in analoging HLA-A2 supermotif-bearing peptides. For example, peptides binding to 3/5 of the A3-supertype molecules are engineered at primary anchor residues to possess a preferred residue (V, S, M, or A) at position 2.

The analog peptides are then tested for the ability to bind A*03 and A*11 (prototype A3 supertype alleles). Those peptides that demonstrate ≦500 nM binding capacity are then confirmed as having A3-supertype cross-reactivity.

Similarly to the A2- and A3-motif bearing peptides, peptides binding 3 or more B7-supertype alleles can be improved, where possible, to achieve increased cross-reactive binding or greater binding affinity or binding half life. B7 supermotif-bearing peptides are, for example, engineered to possess a preferred residue (V, I, L, or F) at the C-terminal primary anchor position, as demonstrated by Sidney et al. (*J. Immunol*. 157:3480–3490, 1996).

Analoging at primary anchor residues of other motif and/or supermotif-bearing epitopes is performed in a like manner.

The analog peptides are then be confirmed for immunogenicity, typically in a cellular screening assay. Again, it is generally important to demonstrate that analog-specific CTLs are also able to recognize the wild-type peptide and, when possible, targets that endogenously express the epitope.

Analoging at Secondary Anchor Residues

Moreover, HLA supermotifs are of value in engineering highly cross-reactive peptides and/or peptides that bind HLA molecules with increased affinity by identifying particular residues at secondary anchor positions that are associated with such properties. For example, the binding capacity of a B7 supermotif-bearing peptide with an F residue at position 1 is analyzed. The peptide is then analoged to, for example, substitute L for F at position 1. The analoged peptide is evaluated for increased binding affinity, binding half life and/or increased cross-reactivity. Such a procedure identifies analoged peptides with enhanced properties.

Engineered analogs with sufficiently improved binding capacity or cross-reactivity can also be tested for immunogenicity in HLA-B7-transgenic mice, following for example, IFA immunization or lipopeptide immunization. Analoged peptides are additionally tested for the ability to stimulate a recall response using PBMC from patients with 282P1G3-expressing tumors.

Other Analoging Strategies

Another form of peptide analoging, unrelated to anchor positions, involves the substitution of a cysteine with α-amino butyric acid. Due to its chemical nature, cysteine has the propensity to form disulfide bridges and sufficiently alter the peptide structurally so as to reduce binding capacity. Substitution of α-amino butyric acid for cysteine not only alleviates this problem, but has been shown to improve binding and crossbinding capabilities in some instances (see, e.g., the review by Sette et al., In: Persistent Viral Infections, Eds. R. Ahmed and I. Chen, John Wiley & Sons, England, 1999).

Thus, by the use of single amino acid substitutions, the binding properties and/or cross-reactivity of peptide ligands for HLA supertype molecules can be modulated.

Example 16

Identification and Confirmation of 282P1G3-Derived Sequences with HLA-DR Binding Motifs Peptide epitopes bearing an HLA class II supermotif or motif are identified and confirmed as outlined below using methodology similar to that described for HLA Class I peptides.

Selection of HLA-DR-Supermotif-Bearing Epitopes.

To identify 282P1G3-derived, HLA class II HTL epitopes, a 282P1G3 antigen is analyzed for the presence of sequences bearing an HLA-DR-motif or supermotif. Specifically, 15-mer sequences are selected comprising a DR-supermotif, comprising a 9-mer core, and three-residue N- and C-terminal flanking regions (15 amino acids total).

Protocols for predicting peptide binding to DR molecules have been developed (Southwood et al., *J. Immunol*. 160: 3363–3373, 1998). These protocols, specific for individual DR molecules, allow the scoring, and ranking, of 9-mer core regions. Each protocol not only scores peptide sequences for the presence of DR-supermotif primary anchors (i.e., at position 1 and position 6) within a 9-mer core, but additionally evaluates sequences for the presence of secondary anchors. Using allele-specific selection tables (see, e.g., Southwood et al., ibid.), it has been found that these protocols efficiently select peptide sequences with a high probability of binding a particular DR molecule. Additionally, it has been found that performing these protocols in tandem, specifically those for DR1, DR4w4, and DR7, can efficiently select DR cross-react peptides.

The 282P1G3-derived peptides identified above are tested for their binding capacity for various common HLA-DR molecules. All peptides are initially tested for binding to the DR molecules in the primary panel: DR1, DR4w4, and DR7. Peptides binding at least two of these three DR molecules are then tested for binding to DR2w2 β1, DR2w2 β2, DR6w19, and DR9 molecules in secondary assays. Finally, peptides binding at least two of the four secondary panel DR molecules, and thus cumulatively at least four of seven different DR molecules, are screened for binding to DR4w15, DR5w11, and DR8w2 molecules in tertiary assays. Peptides binding at least seven of the ten DR molecules comprising the primary, secondary, and tertiary screening assays are considered cross-reactive DR binders. 282P1G3-derived peptides found to bind common HLA-DR alleles are of particular interest.

Selection of DR3 Motif Peptides

Because HLA-DR3 is an allele that is prevalent in Caucasian, Black, and Hispanic populations, DR3 binding capacity is a relevant criterion in the selection of HTL epitopes. Thus, peptides shown to be candidates may also be assayed for their DR3 binding capacity. However, in view of the binding specificity of the DR3 motif, peptides binding only to DR3 can also be considered as candidates for inclusion in a vaccine formulation.

To efficiently identify peptides that bind DR3, target 282P1G3 antigens are analyzed for sequences carrying one of the two DR3-specific binding motifs reported by Geluk et al. (*J. Immunol*. 152:5742–5748, 1994). The corresponding peptides are then synthesized and confirmed as having the ability to bind DR3 with an affinity of 1 μM or better, i.e., less than 1 μM. Peptides are found that meet this binding criterion and qualify as HLA class II high affinity binders.

DR3 binding epitopes identified in this manner are included in vaccine compositions with DR supermotif-bearing peptide epitopes.

Similarly to the case of HLA class I motif-bearing peptides, the class II motif-bearing peptides are analoged to improve affinity or cross-reactivity. For example, aspartic acid at position 4 of the 9-mer core sequence is an optimal residue for DR3 binding, and substitution for that residue often improves DR 3 binding.

Example 17

Immunogenicity of 282P1G3-Derived HTL Epitopes

This example determines immunogenic DR supermotif- and DR3 motif-bearing epitopes among those identified using the methodology set forth herein.

Immunogenicity of HTL epitopes are confirmed in a manner analogous to the determination of immunogenicity of CTL epitopes, by assessing the ability to stimulate HTL responses and/or by using appropriate transgenic mouse models. Immunogenicity is determined by screening for: 1.)

in vitro primary induction using normal PBMC or 2.) recall responses from patients who have 282P1G3-expressing tumors.

Example 18

Calculation of Phenotypic Frequencies of HLA-supertypes in Various Ethnic Backgrounds to Determine Breadth of Population Coverage This example illustrates the assessment of the breadth of population coverage of a vaccine composition comprised of multiple epitopes comprising multiple supermotifs and/or motifs.

In order to analyze population coverage, gene frequencies of HLA alleles are determined. Gene frequencies for each HLA allele are calculated from antigen or allele frequencies utilizing the binomial distribution formulae gf=1−(SQRT(1−af)) (see, e.g., Sidney et al., *Human Immunol*. 45:79–93, 1996). To obtain overall phenotypic frequencies, cumulative gene frequencies are calculated, and the cumulative antigen frequencies derived by the use of the inverse formula $[af=1-(1-Cgf)^2]$.

Where frequency data is not available at the level of DNA typing, correspondence to the serologically defined antigen frequencies is assumed. To obtain total potential supertype population coverage no linkage disequilibrium is assumed, and only alleles confirmed to belong to each of the supertypes are included (minimal estimates). Estimates of total potential coverage achieved by inter-loci combinations are made by adding to the A coverage the proportion of the non-A covered population that could be expected to be covered by the B alleles considered (e.g., total=A+B*(1−A)). Confirmed members of the A3-like supertype are A3, A11, A31, A*3301, and A*6801. Although the A3-like supertype may also include A34, A66, and A*7401, these alleles were not included in overall frequency calculations. Likewise, confirmed members of the A2-like supertype family are A*0201, A*0202, A*0203, A*0204, A*0205, A*0206, A*0207, A*6802, and A*6901. Finally, the B7-like supertype-confirmed alleles are: B7, B*3501-03, B51, B*5301, B*5401, B*5501-2, B*5601, B*6701, and B*7801 (potentially also B*1401, B*3504-06, B*4201, and B*5602).

Population coverage achieved by combining the A2-, A3- and B7-supertypes is approximately 86% in five major ethnic groups. Coverage may be extended by including peptides bearing the A1 and A24 motifs. On average, A1 is present in 12% and A24 in 29% of the population across five different major ethnic groups (Caucasian, North American Black, Chinese, Japanese, and Hispanic). Together, these alleles are represented with an average frequency of 39% in these same ethnic populations. The total coverage across the major ethnicities when A1 and A24 are combined with the coverage of the A2-, A3- and B7-supertype alleles is >95%, see, e.g., Table IV (G). An analogous approach can be used to estimate population coverage achieved with combinations of class II motif-bearing epitopes.

Immunogenicity studies in humans (e.g., Bertoni et al., *J. Clin. Invest*. 100:503, 1997; Doolan et al., *Immunity* 7:97, 1997; and Threlkeld et al., *J. Immunol* 159:1648, 1997) have shown that highly cross-reactive binding peptides are almost always recognized as epitopes. The use of highly cross-reactive binding peptides is an important selection criterion in identifying candidate epitopes for inclusion in a vaccine that is immunogenic in a diverse population.

With a sufficient number of epitopes (as disclosed herein and from the art), an average population coverage is predicted to be greater than 95% in each of five major ethnic populations. The game theory Monte Carlo simulation analysis, which is known in the art (see e.g., Osborne, M. J. and Rubinstein, A. "A course in game theory" MIT Press, 1994), can be used to estimate what percentage of the individuals in a population comprised of the Caucasian, North American Black, Japanese, Chinese, and Hispanic ethnic groups would recognize the vaccine epitopes described herein. A preferred percentage is 90%. A more preferred percentage is 95%.

Example 19

CTL Recognition of Endogenously Processed Antigens After Priming

This example confirms that CTL induced by native or analoged peptide epitopes identified and selected as described herein recognize endogenously synthesized, i.e., native antigens.

Effector cells isolated from transgenic mice that are immunized with peptide epitopes, for example HLA-A2 supermotif-bearing epitopes, are re-stimulated in vitro using peptide-coated stimulator cells. Six days later, effector cells are assayed for cytotoxicity and the cell lines that contain peptide-specific cytotoxic activity are further re-stimulated. An additional six days later, these cell lines are tested for cytotoxic activity on $^{51}$Cr labeled Jurkat-A2.1/$K^b$ target cells in the absence or presence of peptide, and also tested on $^{51}$Cr labeled target cells bearing the endogenously synthesized antigen, i.e. cells that are stably transfected with 282P1G3 expression vectors.

The results demonstrate that CTL lines obtained from animals primed with peptide epitope recognize endogenously synthesized 282P1G3 antigen. The choice of transgenic mouse model to be used for such an analysis depends upon the epitope(s) that are being evaluated. In addition to HLA-A*0201/$K^b$ transgenic mice, several other transgenic mouse models including mice with human A11, which may also be used to evaluate A3 epitopes, and B7 alleles have been characterized and others (e.g., transgenic mice for HLA-A1 and A24) are being developed. HLA-DR1 and HLA-DR3 mouse models have also been developed, which may be used to evaluate HTL epitopes.

Example 20

Activity of CTL-HTL Conjugated Epitopes in Transgenic Mice

This example illustrates the induction of CTLs and HTLs in transgenic mice, by use of a 282P1G3-derived CTL and HTL peptide vaccine compositions. The vaccine composition used herein comprise peptides to be administered to a patient with a 282P1G3-expressing tumor. The peptide composition can comprise multiple CTL and/or HTL epitopes. The epitopes are identified using methodology as described herein. This example also illustrates that enhanced immunogenicity can be achieved by inclusion of one or more HTL epitopes in a CTL vaccine composition; such a peptide composition can comprise an HTL epitope conjugated to a CTL epitope. The CTL epitope can be one that binds to multiple HLA family members at an affinity of 500 nM or less, or analogs of that epitope. The peptides may be lipidated, if desired.

Immunization procedures: Immunization of transgenic mice is performed as described (Alexander et al., *J. Immunol.* 159:4753–4761, 1997). For example, A2/$K^b$ mice, which are transgenic for the human HLA A2.1 allele and are used to confirm the immunogenicity of HLA-A*0201 motif- or HLA-A2 supermotif-bearing epitopes, and are primed subcutaneously (base of the tail) with a 0.1 ml of peptide in Incomplete Freund's Adjuvant, or if the peptide composition is a lipidated CTL/HTL conjugate, in DMSO/saline, or if the peptide composition is a polypeptide, in PBS or Incomplete Freund's Adjuvant. Seven days after priming, splenocytes obtained from these animals are restimulated with syngenic irradiated LPS-activated lymphoblasts coated with peptide.

Cell lines: Target cells for peptide-specific cytotoxicity assays are Jurkat cells transfected with the HLA-A2.1/$K^b$ chimeric gene (e.g., Vitiello et al., *J. Exp. Med.* 173:1007, 1991)

In vitro CTL activation: One week after priming, spleen cells ($30\times10^6$ cells/flask) are co-cultured at 37° C. with syngeneic, irradiated (3000 rads), peptide coated lymphoblasts ($10\times10^6$ cells/flask) in 10 ml of culture medium/T25 flask. After six days, effector cells are harvested and assayed for cytotoxic activity.

Assay for cytotoxic activity: Target cells (1.0 to $1.5\times10^6$) are incubated at 37° C. in the presence of 200 μl of $^{51}$Cr. After 60 minutes, cells are washed three times and resuspended in R10 medium. Peptide is added where required at a concentration of 1 μg/ml. For the assay, $10^4$ $^{51}$Cr-labeled target cells are added to different concentrations of effector cells (final volume of 200 μl) in U-bottom 96-well plates. After a six hour incubation period at 37° C., a 0.1 ml aliquot of supernatant is removed from each well and radioactivity is determined in a Micromedic automatic gamma counter. The percent specific lysis is determined by the formula: percent specific release=100×(experimental release−spontaneous release)/(maximum release−spontaneous release). To facilitate comparison between separate CTL assays run under the same conditions, % $^{51}$Cr release data is expressed as lytic units/$10^6$ cells. One lytic unit is arbitrarily defined as the number of effector cells required to achieve 30% lysis of 10,000 target cells in a six hour $^{51}$Cr release assay. To obtain specific lytic units/$10^6$, the lytic units/$10^6$ obtained in the absence of peptide is subtracted from the lytic units/$10^6$ obtained in the presence of peptide. For example, if 30% $^{51}$Cr release is obtained at the effector (E): target (T) ratio of 50:1 (i.e., $5\times10^5$ effector cells for 10,000 targets) in the absence of peptide and 5:1 (i.e., $5\times10^4$ effector cells for 10,000 targets) in the presence of peptide, the specific lytic units would be: $[(1/50{,}000)-(1/500{,}000)]\times10^6=18$ LU.

The results are analyzed to assess the magnitude of the CTL responses of animals injected with the immunogenic CTL/HTL conjugate vaccine preparation and are compared to the magnitude of the CTL response achieved using, for example, CTL epitopes as outlined above in the Example entitled "Confirmation of Immunogenicity." Analyses similar to this may be performed to confirm the immunogenicity of peptide conjugates containing multiple CTL epitopes and/or multiple HTL epitopes. In accordance with these procedures, it is found that a CTL response is induced, and concomitantly that an HTL response is induced upon administration of such compositions.

Example 21

Selection of CTL and HTL Epitopes for Inclusion in a 282P1G3-specific Vaccine This example illustrates a procedure for selecting peptide epitopes for vaccine compositions of the invention. The peptides in the composition can be in the form of a nucleic acid sequence, either single or one or more sequences (i.e., minigene) that encodes peptide(s), or can be single and/or polyepitopic peptides.

The following principles are utilized when selecting a plurality of epitopes for inclusion in a vaccine composition. Each of the following principles is balanced in order to make the selection.

Epitopes are selected which, upon administration, mimic immune responses that are correlated with 282P1G3 clearance. The number of epitopes used depends on observations of patients who spontaneously clear 282P1G3. For example, if it has been observed that patients who spontaneously clear 282P1G3-expressing cells generate an immune response to at least three (3) epitopes from 282P1G3 antigen, then at least three epitopes should be included for HLA class I. A similar rationale is used to determine HLA class II epitopes.

Epitopes are often selected that have a binding affinity of an IC50 of 500 nM or less for an HLA class I molecule, or for class II, an IC50 of 1000 nM or less; or HLA Class I peptides with high binding scores from the BIMAS web site.

In order to achieve broad coverage of the vaccine through out a diverse population, sufficient supermotif bearing peptides, or a sufficient array of allele-specific motif bearing peptides, are selected to give broad population coverage. In one embodiment, epitopes are selected to provide at least 80% population coverage. A Monte Carlo analysis, a statistical evaluation known in the art, can be employed to assess breadth, or redundancy, of population coverage.

When creating polyepitopic compositions, or a minigene that encodes same, it is typically desirable to generate the smallest peptide possible that encompasses the epitopes of interest. The principles employed are similar, if not the same, as those employed when selecting a peptide comprising nested epitopes. For example, a protein sequence for the vaccine composition is selected because it has maximal number of epitopes contained within the sequence, i.e., it has a high concentration of epitopes. Epitopes may be nested or overlapping (i.e., frame shifted relative to one another). For example, with overlapping epitopes, two 9-mer epitopes and one 10-mer epitope can be present in a 10 amino acid peptide. Each epitope can be exposed and bound by an HLA molecule upon administration of such a peptide. A multi-epitopic, peptide can be generated synthetically, recombinantly, or via cleavage from the native source. Alternatively, an analog can be made of this native sequence, whereby one or more of the epitopes comprise substitutions that alter the cross-reactivity and/or binding affinity properties of the polyepitopic peptide. Such a vaccine composition is administered for therapeutic or prophylactic purposes. This embodiment provides for the possibility that an as yet undiscovered aspect of immune system processing will apply to the native nested sequence and thereby facilitate the production of therapeutic or prophylactic immune response inducing vaccine compositions. Additionally such an embodiment provides for the possibility of motif-bearing epitopes for an HLA makeup that is presently unknown. Furthermore, this embodiment (absent the creating of any analogs) directs the immune response to multiple peptide sequences that are actually present in 282P1G3, thus avoiding the need to evaluate any junctional epitopes. Lastly, the embodiment provides an economy of scale when producing nucleic acid vaccine compositions. Related to this embodiment, computer programs can be derived in accordance with principles in the art, which identify in a target sequence, the greatest number of epitopes per sequence length.

A vaccine composition comprised of selected peptides, when administered, is safe, efficacious, and elicits an immune response similar in magnitude to an immune response that controls or clears cells that bear or overexpress 282P1G3.

Example 22

Construction of "Minigene" Multi-Epitope DNA Plasmids

This example discusses the construction of a minigene expression plasmid. Minigene plasmids may, of course, contain various configurations of B cell, CTL and/or HTL epitopes or epitope analogs as described herein.

A minigene expression plasmid typically includes multiple CTL and HTL peptide epitopes. In the present example, HLA-A2, -A3, -B7 supermotif-bearing peptide epitopes and HLA-A1 and -A24 motif-bearing peptide epitopes are used in conjunction with DR supermotif-bearing epitopes and/or DR3 epitopes. HLA class I supermotif or motif-bearing peptide epitopes derived 282P1G3, are selected such that multiple supermotifs/mofifs are represented to ensure broad population coverage. Similarly, HLA class II epitopes are selected from 282P1G3 to provide broad population coverage, i.e. both HLA DR-1-4-7 supermotif-bearing epitopes and HLA DR-3 motif-bearing epitopes are selected for inclusion in the minigene construct. The selected CTL and HTL epitopes are then incorporated into a minigene for expression in an expression vector.

Such a construct may additionally include sequences that direct the HTL epitopes to the endoplasmic reticulum. For example, the Ii protein may be fused to one or more HTL epitopes as described in the art, wherein the CLIP sequence of the I protein is removed and replaced with an HLA class II epitope sequence so that HLA class II epitope is directed to the endoplasmic reticulum, where the epitope binds to an HLA class II molecules.

This example illustrates the methods to be used for construction of a minigene-bearing expression plasmid. Other expression vectors that may be used for minigene compositions are available and known to those of skill in the art.

The minigene DNA plasmid of this example contains a consensus Kozak sequence and a consensus murine kappa lg-light chain signal sequence followed by CTL and/or HTL epitopes selected in accordance with principles disclosed herein. The sequence encodes an open reading frame fused to the Myc and His antibody epitope tag coded for by the pcDNA 3.1 Myc-His vector.

Overlapping oligonucleotides that can, for example, average about 70 nucleotides in length with 15 nucleotide overlaps, are synthesized and HPLC-purified. The oligonucleotides encode the selected peptide epitopes as well as appropriate linker nucleotides, Kozak sequence, and signal sequence. The final multiepitope minigene is assembled by extending the overlapping oligonucleotides in three sets of reactions using PCR. A Perkin/Elmer 9600 PCR machine is used and a total of 30 cycles are performed using the following conditions: 95° C. for 15 sec, annealing temperature (5° below the lowest calculated Tm of each primer pair) for 30 sec, and 72° C. for 1 min.

For example, a minigene is prepared as follows. For a first PCR reaction, 5 μg of each of two oligonucleotides are annealed and extended: In an example using eight oligonucleotides, i.e., four pairs of primers, oligonucleotides 1+2, 3+4, 5+6, and 7+8 are combined in 100 μl reactions containing Pfu polymerase buffer (1×=10 mM KCL, 10 nM $(NH4)_2SO_4$, 20 mM Tris-chloride, pH 8.75, 2 mM $MgSO_4$, 0.1% Triton X-100, 100 μg/ml BSA), 0.25 mM each dNTP, and 2.5 U of Pfu polymerase. The full-length dimer products are gel-purified, and two reactions containing the product of 1+2 and 3+4, and the product of 5+6 and 7+8 are mixed, annealed, and extended for 10 cycles. Half of the two reactions are then mixed, and 5 cycles of annealing and extension carried out before flanking primers are added to amplify the full length product. The full-length product is gel-purified and cloned into pCR-blunt (Invitrogen) and individual clones are screened by sequencing.

Example 23

The Plasmid Construct and the Degree to Which it Induces Immunogenicity

The degree to which a plasmid construct, for example a plasmid constructed in accordance with the previous Example, is able to induce immunogenicity is confirmed in vitro by determining epitope presentation by APC following transduction or transfection of the APC with an epitope-expressing nucleic acid construct. Such a study determines "antigenicity" and allows the use of human APC. The assay determines the ability of the epitope to be presented by the APC in a context that is recognized by a T cell by quantifying the density of epitope-HLA class I complexes on the cell surface. Quantitation can be performed by directly measuring the amount of peptide eluted from the APC (see, e.g., Sijts et al., *J. Immunol.* 156:683–692, 1996; Demotz et al., *Nature* 342:682–684, 1989); or the number of peptide-HLA class I complexes can be estimated by measuring the amount of lysis or lymphokine release induced by diseased or transfected target cells, and then determining the concentration of peptide necessary to obtain equivalent levels of lysis or lymphokine release (see, e.g., Kageyama et al., *J. Immunol.* 154:567–576, 1995).

Alternatively, immunogenicity is confirmed through in vivo injections into mice and subsequent in vitro assessment of CTL and HTL activity, which are analyzed using cytotoxicity and proliferation assays, respectively, as detailed e.g., in Alexander et al., *Immunity* 1:751–761, 1994.

For example, to confirm the capacity of a DNA minigene construct containing at least one HLA-A2 supermotif peptide to induce CTLs in vivo, HLA-A2.1/$K^b$ transgenic mice, for example, are immunized intramuscularly with 100 μg of naked cDNA. As a means of comparing the level of CTLs induced by cDNA immunization, a control group of animals is also immunized with an actual peptide composition that comprises multiple epitopes synthesized as a single polypeptide as they would be encoded by the minigene.

Splenocytes from immunized animals are stimulated twice with each of the respective compositions (peptide epitopes encoded in the minigene or the polyepitopic peptide), then assayed for peptide-specific cytotoxic activity in a $^{51}Cr$ release assay. The results indicate the magnitude of the CTL response directed against the A2-restricted epitope, thus indicating the in vivo immunogenicity of the minigene vaccine and polyepitopic vaccine.

It is, therefore, found that the minigene elicits immune responses directed toward the HLA-A2 supermotif peptide epitopes as does the polyepitopic peptide vaccine. A similar analysis is also performed using other HLA-A3 and HLA-B7 transgenic mouse models to assess CTL induction by HLA-A3 and HLA-B7 motif or supermotif epitopes, whereby it is also found that the minigene elicits appropriate immune responses directed toward the provided epitopes.

To confirm the capacity of a class II epitope-encoding minigene to induce HTLs in vivo, DR transgenic mice, or for those epitopes that cross react with the appropriate mouse MHC molecule, I-$A^b$-restricted mice, for example, are immunized intramuscularly with 100 μg of plasmid DNA. As a means of comparing the level of HTLs induced by DNA immunization, a group of control animals is also immunized with an actual peptide composition emulsified in complete Freund's adjuvant. CD4+ T cells, i.e. HTLs, are purified from splenocytes of immunized animals and stimulated with each of the respective compositions (peptides encoded in the minigene). The HTL response is measured using a $^3$H-thymidine incorporation proliferation assay, (see, e.g., Alexander et al. Immunity 1:751–761, 1994). The results indicate the magnitude of the HTL response, thus demonstrating the in vivo immunogenicity of the minigene.

DNA minigenes, constructed as described in the previous Example, can also be confirmed as a vaccine in combination with a boosting agent using a prime boost protocol. The boosting agent can consist of recombinant protein (e.g., Barnett et al., *Aids Res. and Human Retroviruses* 14, Supplement 3:S299–S309, 1998) or recombinant vaccinia, for example, expressing a minigene or DNA encoding the complete protein of interest (see, e.g., Hanke et al., *Vaccine* 16:439–445, 1998; Sedegah et al., *Proc. Natl. Acad. Sci USA* 95:7648–53, 1998; Hanke and McMichael, *Immunol. Letters* 66:177–181, 1999; and Robinson et al., *Nature Med.* 5:526–34, 1999).

For example, the efficacy of the DNA minigene used in a prime boost protocol is initially evaluated in transgenic mice. In this example, A2.1/$K^b$ transgenic mice are immunized IM with 100 μg of a DNA minigene encoding the immunogenic peptides including at least one HLA-A2 supermotif-bearing peptide. After an incubation period (ranging from 3–9 weeks), the mice are boosted IP with $10^7$ pfu/mouse of a recombinant vaccinia virus expressing the same sequence encoded by the DNA minigene. Control mice are immunized with 100 μg of DNA or recombinant vaccinia without the minigene sequence, or with DNA encoding the minigene, but without the vaccinia boost. After an additional incubation period of two weeks, splenocytes from the mice are immediately assayed for peptide-specific activity in an ELISPOT assay. Additionally, splenocytes are stimulated in vitro with the A2-restricted peptide epitopes encoded in the minigene and recombinant vaccinia, then assayed for peptide-specific activity in an alpha, beta and/or gamma IFN ELISA.

It is found that the minigene utilized in a prime-boost protocol elicits greater immune responses toward the HLA-A2 supermotif peptides than with DNA alone. Such an analysis can also be performed using HLA-A11 or HLA-B7 transgenic mouse models to assess CTL induction by HLA-A3 or HLA-B7 motif or supermotif epitopes. The use of prime boost protocols in humans is described below in the Example entitled "Induction of CTL Responses Using a Prime Boost Protocol."

Example 24

Peptide Compositions for Prophylactic Uses

Vaccine compositions of the present invention can be used to prevent 282P1G3 expression in persons who are at risk for tumors that bear this antigen. For example, a polyepitopic peptide epitope composition (or a nucleic acid comprising the same) containing multiple CTL and HTL epitopes such as those selected in the above Examples, which are also selected to target greater than 80% of the population, is administered to individuals at risk for a 282P1G3-associated tumor.

For example, a peptide-based composition is provided as a single polypeptide that encompasses multiple epitopes. The vaccine is typically administered in a physiological solution that comprises an adjuvant, such as Incomplete Freunds Adjuvant. The dose of peptide for the initial immunization is from about 1 to about 50,000 μg, generally 100–5,000 μg, for a 70 kg patient. The initial administration of vaccine is followed by booster dosages at 4 weeks followed by evaluation of the magnitude of the immune response in the patient, by techniques that determine the presence of epitope-specific CTL populations in a PBMC sample. Additional booster doses are administered as required. The composition is found to be both safe and efficacious as a prophylaxis against 282P1G3-associated disease.

Alternatively, a composition typically comprising transfecting agents is used for the administration of a nucleic acid-based vaccine in accordance with methodologies known in the art and disclosed herein.

Example 25

Polyepitopic Vaccine Compositions Derived from Native 282P1G3 Sequences

A native 282P1G3 polyprotein sequence is analyzed, preferably using computer algorithms defined for each class I and/or class II supermotif or motif, to identify "relatively short" regions of the polyprotein that comprise multiple epitopes. The relatively "relatively short" regions are preferably less in length than an entire native antigen. This relatively short sequence that contains multiple distinct or overlapping, "nested" epitopes can be used to generate a minigene construct. The construct is engineered to express the peptide, which corresponds to the native protein sequence. The "relatively short" peptide is generally less than 250 amino acids in length, often less than 100 amino acids in length, preferably less than 75 amino acids in length, and more preferably less than 50 amino acids in length. The protein sequence of the vaccine composition is selected because it has maximal number of epitopes contained within the sequence, i.e., it has a high concentration of epitopes. As noted herein, epitope motifs may be nested or overlapping (i.e., frame shifted relative to one another). For example, with overlapping epitopes, two 9-mer epitopes and one 10-mer epitope can be present in a 10 amino acid peptide. Such a vaccine composition is administered for therapeutic or prophylactic purposes.

The vaccine composition will include, for example, multiple CTL epitopes from 282P1G3 antigen and at least one HTL epitope. This polyepitopic native sequence is administered either as a peptide or as a nucleic acid sequence which encodes the peptide. Alternatively, an analog can be made of this native sequence, whereby one or more of the epitopes comprise substitutions that alter the cross-reactivity and/or binding affinity properties of the polyepitopic peptide.

The embodiment of this example provides for the possibility that an as yet undiscovered aspect of immune system processing will apply to the native nested sequence and thereby facilitate the production of therapeutic or prophylactic immune response-inducing vaccine compositions. Additionally, such an embodiment provides for the possibility of motif-bearing epitopes for an HLA makeup(s) that is presently unknown. Furthermore, this embodiment (excluding an analoged embodiment) directs the immune response to multiple peptide sequences that are actually present in native 282P1G3, thus avoiding the need to evaluate any junctional epitopes. Lastly, the embodiment provides an economy of scale when producing peptide or nucleic acid vaccine compositions.

Related to this embodiment, computer programs are available in the art which can be used to identify in a target sequence, the greatest number of epitopes per sequence length.

Example 26

Polyepitopic Vaccine Compositions from Multiple Antigens

The 282P1G3 peptide epitopes of the present invention are used in conjunction with epitopes from other target tumor-associated antigens, to create a vaccine composition that is useful for the prevention or treatment of cancer that expresses 282P1G3 and such other antigens. For example, a vaccine composition can be provided as a single polypeptide that incorporates multiple epitopes from 282P1G3 as well as tumor-associated antigens that are often expressed with a target cancer associated with 282P1G3 expression, or can be administered as a composition comprising a cocktail of one or more discrete epitopes. Alternatively, the vaccine can be administered as a minigene construct or as dendritic cells which have been loaded with the peptide epitopes in vitro.

Example 27

Use of Peptides to Evaluate an Immune Response

Peptides of the invention may be used to analyze an immune response for the presence of specific antibodies, CTL or HTL directed to 282P1G3. Such an analysis can be performed in a manner described by Ogg et al., *Science* 279:2103–2106, 1998. In this Example, peptides in accordance with the invention are used as a reagent for diagnostic or prognostic purposes, not as an immunogen.

In this example highly sensitive human leukocyte antigen tetrameric complexes ("tetramers") are used for a cross-sectional analysis of, for example, 282P1G3 HLA-A*0201-specific CTL frequencies from HLA A*0201-positive individuals at different stages of disease or following immunization comprising a 282P1G3 peptide containing an A*0201 motif. Tetrameric complexes are synthesized as described (Musey et al., *N. Engl. J. Med.* 337:1267, 1997). Briefly, purified HLA heavy chain (A*0201 in this example) and β2-microglobulin are synthesized by means of a prokaryotic expression system. The heavy chain is modified by deletion of the transmembrane-cytosolic tail and COOH-terminal addition of a sequence containing a BirA enzymatic biotinylation site. The heavy chain, β2-microglobulin, and peptide are refolded by dilution. The 45-kD refolded product is isolated by fast protein liquid chromatography and then biotinylated by BirA in the presence of biotin (Sigma, St. Louis, Mo.), adenosine 5' triphosphate and magnesium. Streptavidin-phycoerythrin conjugate is added in a 1:4 molar ratio, and the tetrameric product is concentrated to 1 mg/ml. The resulting product is referred to as tetramer-phycoerythrin.

For the analysis of patient blood samples, approximately one million PBMCs are centrifuged at 300 g for 5 minutes and resuspended in 50 μl of cold phosphate-buffered saline. Tri-color analysis is performed with the tetramer-phycoerythrin, along with anti-CD8-Tricolor, and anti-CD38. The PBMCs are incubated with tetramer and antibodies on ice for 30 to 60 min and then washed twice before formaldehyde fixation. Gates are applied to contain >99.98% of control samples. Controls for the tetramers include both A*0201-negative individuals and A*0201-positive non-diseased donors. The percentage of cells stained with the tetramer is then determined by flow cytometry. The results indicate the number of cells in the PBMC sample that contain epitope-restricted CTLs, thereby readily indicating the extent of immune response to the 282P1G3 epitope, and thus the status of exposure to 282P1G3, or exposure to a vaccine that elicits a protective or therapeutic response.

Example 28

Use of Peptide Epitopes to Evaluate Recall Responses

The peptide epitopes of the invention are used as reagents to evaluate T cell responses, such as acute or recall responses, in patients. Such an analysis may be performed on patients who have recovered from 282P1G3-associated disease or who have been vaccinated with a 282P1G3 vaccine.

For example, the class I restricted CTL response of persons who have been vaccinated may be analyzed. The vaccine may be any 282P1G3 vaccine. PBMC are collected from vaccinated individuals and HLA typed. Appropriate peptide epitopes of the invention that, optimally, bear supermotifs to provide cross-reactivity with multiple HLA supertype family members, are then used for analysis of samples derived from individuals who bear that HLA type.

PBMC from vaccinated individuals are separated on Ficoll-Histopaque density gradients (Sigma Chemical Co., St. Louis, Mo.), washed three times in HBSS (GIBCO Laboratories), resuspended in RPMI-1640 (GIBCO Laboratories) supplemented with L-glutamine (2 mM), penicillin (50U/ml), streptomycin (50 μg/ml), and Hepes (10 mM) containing 10% heat-inactivated human AB serum (complete RPMI) and plated using microculture formats. A synthetic peptide comprising an epitope of the invention is added at 10 μg/ml to each well and HBV core 128–140 epitope is added at 1 μg/ml to each well as a source of T cell help during the first week of simulation.

In the microculture format, $4\times10^5$ PBMC are stimulated with peptide in 8 replicate cultures in 96-well round bottom plate in 100 μl/well of complete RPMI. On days 3 and 10, 100 μl of complete RPMI and 20 U/ml final concentration of rIL-2 are added to each well. On day 7 the cultures are transferred into a 96-well flat-bottom plate and restimulated with peptide, rIL-2 and $10^5$ irradiated (3,000 rad) autologous feeder cells. The cultures are tested for cytotoxic activity on day 14. A positive CTL response requires two or more of the eight replicate cultures to display greater than 10% specific $^{51}Cr$ release based on comparison with non-diseased control subjects as previously described (Rehermann, et al., *Nature Med.* 2:1104,1108, 1996; Rehermann et al., *J. Clin. Invest.* 97:1655–1665,1996; and Rehermann et al. *J. Clin. Invest.* 98:1432–1440, 1996).

Target cell lines are autologous and allogeneic EBV-transformed B-LCL that are either purchased from the American Society for Histocompatibility and Immunogenetics (ASHI, Boston, Mass.) or established from the pool of patients as described (Guilhot, et al. *J. Virol.* 66:2670–2678, 1992).

Cytotoxicity assays are performed in the following manner. Target cells consist of either allogeneic HLA-matched or autologous EBV-transformed B lymphoblastoid cell line that are incubated overnight with the synthetic peptide epitope of the invention at 10 μM, and labeled with 100 μCi of $^{51}Cr$ (Amersham Corp., Arlington Heights, Ill.) for 1 hour after which they are washed four times with HBSS.

Cytolytic activity is determined in a standard 4-h, split well $^{51}Cr$ release assay using U-bottomed 96 well plates containing 3,000 targets/well. Stimulated PBMC are tested at effector/target (E/T) ratios of 20–50:1 on day 14. Percent cytotoxicity is determined from the formula: 100×[(experimental release−spontaneous release)/maximum release−spontaneous release)]. Maximum release is determined by lysis of targets by detergent (2% Triton X-100; Sigma Chemical Co., St. Louis, Mo.). Spontaneous release is <25% of maximum release for all experiments.

The results of such an analysis indicate the extent to which HLA-restricted CTL populations have been stimulated by previous exposure to 282P1G3 or a 282P1G3 vaccine.

Similarly, Class II restricted HTL responses may also be analyzed. Purified PBMC are cultured in a 96-well flat bottom plate at a density of $1.5\times10^5$ cells/well and are stimulated with 10 μg/ml synthetic peptide of the invention, whole 282P1G3 antigen, or PHA. Cells are routinely plated in replicates of 4–6 wells for each condition. After seven days of culture, the medium is removed and replaced with fresh medium containing 10U/ml IL-2. Two days later, 1 μCi $^3H$-thymidine is added to each well and incubation is continued for an additional 18 hours. Cellular DNA is then harvested on glass fiber mats and analyzed for $^3H$-thymidine incorporation. Antigen-specific T cell proliferation is calculated as the ratio of $^3H$-thymidine incorporation in the presence of antigen divided by the $^3H$-thymidine incorporation in the absence of antigen.

Example 29

Induction of Specific CTL Response in Humans

A human clinical trial for an immunogenic composition comprising CTL and HTL epitopes of the invention is set up as an IND Phase I, dose escalation study and carried out as a randomized, double-blind, placebo-controlled trial. Such a trial is designed, for example, as follows:

A total of about 27 individuals are enrolled and divided into 3 groups:

Group I: 3 subjects are injected with placebo and 6 subjects are injected with 5 μg of peptide composition;

Group II: 3 subjects are injected with placebo and 6 subjects are injected with 50 μg peptide composition;

Group III: 3 subjects are injected with placebo and 6 subjects are injected with 500 μg of peptide composition.

After 4 weeks following the first injection, all subjects receive a booster inoculation at the same dosage.

The endpoints measured in this study relate to the safety and tolerability of the peptide composition as well as its immunogenicity. Cellular immune responses to the peptide composition are an index of the intrinsic activity of this the peptide composition, and can therefore be viewed as a measure of biological efficacy. The following summarize the clinical and laboratory data that relate to safety and efficacy endpoints.

Safety: The incidence of adverse events is monitored in the placebo and drug treatment group and assessed in terms of degree and reversibility.

Evaluation of Vaccine Efficacy: For evaluation of vaccine efficacy, subjects are bled before and after injection. Peripheral blood mononuclear cells are isolated from fresh heparinized blood by Ficoll-Hypaque density gradient centrifugation, aliquoted in freezing media and stored frozen. Samples are assayed for CTL and HTL activity.

The vaccine is found to be both safe and efficacious.

Example 30

Phase II Trials in Patients Expressing 282P1G3

Phase II trials are performed to study the effect of administering the CTL-HTL peptide compositions to patients having cancer that expresses 282P1G3. The main objectives of the trial are to determine an effective dose and regimen for inducing CTLs in cancer patients that express 282P1G3, to establish the safety of inducing a CTL and HTL response in these patients, and to see to what extent activation of CTLs improves the clinical picture of these patients, as manifested, e.g., by the reduction and/or shrinking of lesions. Such a study is designed, for example, as follows:

The studies are performed in multiple centers. The trial design is an open-label, uncontrolled, dose escalation protocol wherein the peptide composition is administered as a single dose followed six weeks later by a single booster shot of the same dose. The dosages are 50, 500 and 5,000 micrograms per injection. Drug-associated adverse effects (severity and reversibility) are recorded.

There are three patient groupings. The first group is injected with 50 micrograms of the peptide composition and the second and third groups with 500 and 5,000 micrograms of peptide composition, respectively. The patients within each group range in age from 21–65 and represent diverse ethnic backgrounds. All of them have a tumor that expresses 282P1G3.

Clinical manifestations or antigen-specific T-cell responses are monitored to assess the effects of administering the peptide compositions. The vaccine composition is found to be both safe and efficacious in the treatment of 282P1G3-associated disease.

Example 31

Induction of CTL Responses Using a Prime Boost Protocol

A prime boost protocol similar in its underlying principle to that used to confirm the efficacy of a DNA vaccine in transgenic mice, such as described above in the Example entitled "The Plasmid Construct and the Degree to Which It Induces Immunogenicity," can also be used for the administration of the vaccine to humans. Such a vaccine regimen can include an initial administration of, for example, naked DNA followed by a boost using recombinant virus encoding the vaccine, or recombinant protein/polypeptide or a peptide mixture administered in an adjuvant.

For example, the initial immunization may be performed using an expression vector, such as that constructed in the Example entitled "Construction of "Minigene" Multi-Epitope DNA Plasmids" in the form of naked nucleic acid administered IM (or SC or ID) in the amounts of 0.5–5 mg at multiple sites. The nucleic acid (0.1 to 1000 μg) can also be administered using a gene gun. Following an incubation period of 3–4 weeks, a booster dose is then administered. The booster can be recombinant fowlpox virus administered at a dose of 5–$10^7$ to $5\times10^9$ pfu. An alternative recombinant virus, such as an MVA, canarypox, adenovirus, or adeno-associated virus, can also be used for the booster, or the polyepitopic protein or a mixture of the peptides can be administered. For evaluation of vaccine efficacy, patient blood samples are obtained before immunization as well as at intervals following administration of the initial vaccine and booster doses of the vaccine. Peripheral blood mononuclear cells are isolated from fresh heparinized blood by Ficoll-Hypaque density gradient centrifugation, aliquoted in freezing media and stored frozen. Samples are assayed for CTL and HTL activity.

Analysis of the results indicates that a magnitude of response sufficient to achieve a therapeutic or protective immunity against 282P1G3 is generated.

Example 32

Administration of Vaccine Compositions Using Dendritic Cells (DC)

Vaccines comprising peptide epitopes of the invention can be administered using APCs, or "professional" APCs such as DC. In this example, peptide-pulsed DC are administered to a patient to stimulate a CTL response in vivo. In this method, dendritic cells are isolated, expanded, and pulsed with a vaccine comprising peptide CTL and HTL epitopes of the invention. The dendritic cells are infused back into the patient to elicit CTL and HTL responses in vivo. The induced CTL and HTL then destroy or facilitate destruction, respectively, of the target cells that bear the 282P1G3 protein from which the epitopes in the vaccine are derived.

For example, a cocktail of epitope-comprising peptides is administered ex vivo to PBMC, or isolated DC therefrom. A pharmaceutical to facilitate harvesting of DC can be used, such as Progenipoietin™(Monsanto, St. Louis, Mo.) or GM-CSF/IL-4. After pulsing the DC with peptides, and prior to reinfusion into patients, the DC are washed to remove unbound peptides.

As appreciated clinically, and readily determined by one of skill based on clinical outcomes, the number of DC reinfused into the patient can vary (see, e.g., *Nature Med.* 4:328, 1998; *Nature Med.* 2:52, 1996 and *Prostate* 32:272, 1997). Although 2–$50\times10^6$ DC per patient are typically administered, larger number of DC, such as $10^7$ or $10^8$ can also be provided. Such cell populations typically contain between 50–90% DC.

In some embodiments, peptide-loaded PBMC are injected into patients without purification of the DC. For example, PBMC generated after treatment with an agent such as Progenipoietin™ are injected into patients without purification of the DC. The total number of PBMC that are administered often ranges from $10^8$ to $10^{10}$. Generally, the cell doses injected into patients is based on the percentage of DC in the blood of each patient, as determined, for example, by immunofluorescence analysis with specific anti-DC antibodies. Thus, for example, if Progenipoietin™ mobilizes 2% DC in the peripheral blood of a given patient, and that patient is to receive $5\times10^6$ DC, then the patient will be injected with a total of $2.5\times10^8$ peptide-loaded PBMC. The percent DC mobilized by an agent such as Progenipoietin™ is typically estimated to be between 2–10%, but can vary as appreciated by one of skill in the art.

Ex vivo Activation of CTL/HTL Responses

Alternatively, ex vivo CTL or HTL responses to 282P1G3 antigens can be induced by incubating, in tissue culture, the patients, or genetically compatible, CTL or HTL precursor cells together with a source of APC, such as DC, and immunogenic peptides. After an appropriate incubation time (typically about 7–28 days), in which the precursor cells are activated and expanded into effector cells, the cells are infused into the patient, where they will destroy (CTL) or facilitate destruction (HTL) of their specific target cells, i.e., tumor cells.

Example 33

An Alternative Method of Identifying and Confirming Motif-Bearing Peptides

Another method of identifying and confirming motif-bearing peptides is to elute them from cells bearing defined MHC molecules. For example, EBV transformed B cell lines used for tissue typing have been extensively characterized to determine which HLA molecules they express. In certain cases these cells express only a single type of HLA molecule. These cells can be transfected with nucleic acids that express the antigen of interest, e.g. 282P1G3. Peptides produced by endogenous antigen processing of peptides produced as a result of transfection will then bind to HLA molecules within the cell and be transported and displayed on the cell's surface. Peptides are then eluted from the HLA molecules by exposure to mild acid conditions and their amino acid sequence determined, e.g., by mass spectral analysis (e.g., Kubo et al., *J. Immunol.* 152:3913, 1994). Because the majority of peptides that bind a particular HLA molecule are motif-bearing, this is an alternative modality for obtaining the motif-bearing peptides correlated with the particular HLA molecule expressed on the cell.

Alternatively, cell lines that do not express endogenous HLA molecules can be transfected with an expression construct encoding a single HLA allele. These cells can then be used as described, i.e., they can then be transfected with nucleic acids that encode 282P1G3 to isolate peptides corresponding to 282P1G3 that have been presented on the cell surface. Peptides obtained from such an analysis will bear motif(s) that correspond to binding to the single HLA allele that is expressed in the cell.

As appreciated by one in the art, one can perform a similar analysis on a cell bearing more than one HLA allele and subsequently determine peptides specific for each HLA allele expressed. Moreover, one of skill would also recognize that means other than transfection, such as loading with a protein antigen, can be used to provide a source of antigen to the cell.

Example 34

Complementary Polynucleotides

Sequences complementary to the 282P1G3-encoding sequences, or any parts thereof, are used to detect, decrease, or inhibit expression of naturally occurring 282P1G3.

Although use of oligonucleotides comprising from about 15 to 30 base pairs is described, essentially the same procedure is used with smaller or with larger sequence fragments. Appropriate oligonucleotides are designed using, e.g., OLIGO 4.06 software (National Biosciences) and the coding sequence of 282P1G3. To inhibit transcription, a complementary oligonucleotide is designed from the most unique 5' sequence and used to prevent promoter binding to the coding sequence. To inhibit translation, a complementary oligonucleotide is designed to prevent ribosomal binding to a 282P1G3-encoding transcript.

Example 35

Purification of Naturally-occurring or Recombinant 282P1G3 Using 282P1G3-Specific Antibodies Naturally occurring or recombinant 282P1G3 is substantially purified by immunoaffinity chromatography using antibodies specific for 282P1G3. An immunoaffinity column is constructed by covalently coupling anti-282P1G3 antibody to an activated chromatographic resin, such as CNBr-activated SEPHAROSE (Amersham Pharmacia Biotech). After the coupling, the resin is blocked and washed according to the manufacturer's instructions.

Media containing 282P1G3 are passed over the immunoaffinity column, and the column is washed under conditions that allow the preferential absorbance of 282P1G3 (e.g., high ionic strength buffers in the presence of detergent). The column is eluted under conditions that disrupt antibody/282P1G3 binding (e.g., a buffer of pH 2 to pH 3, or a high concentration of a chaotrope, such as urea or thiocyanate ion), and GCR.P is collected.

Example 36

Identification of Molecules which Interact with 282P1G3

282P1G3, or biologically active fragments thereof, are labeled with 121 1 Bolton-Hunter reagent. (See, e.g., Bolton et al. (1973) Biochem. J. 133:529.) Candidate molecules previously arrayed in the wells of a multi-well plate are incubated with the labeled 282P1G3, washed, and any wells with labeled 282P1G3 complex are assayed. Data obtained using different concentrations of 282P1G3 are used to calculate values for the number, affinity, and association of 282P1G3 with the candidate molecules.

Example 37

In Vivo Assay for 282P1G3 Tumor Growth Promotion

The effect of the 282P1G3 protein on tumor cell growth is evaluated in vivo by evaluating tumor development and growth of cells expressing or lacking 282P1G3. For example, SCID mice are injected subcutaneously on each flank with $1\times10^6$ of either 3T3, ovarian (e.g. PA-1 cells), pancreatic (e.g. Panc-1 cells) or lymphoma (e.g. Daudi cells) cancer cell lines containing tkNeo empty vector or 282P1G3. At least two strategies may be used: (1) Constitutive 282P1G3 expression under regulation of a promoter such as a constitutive promoter obtained from the genomes of viruses such as polyoma virus, fowlpox virus (UK 2,211,504 published 5 Jul. 1989), adenovirus (such as Adenovirus 2), bovine papilloma virus, avian sarcoma virus, cytomegalovirus, a retrovirus, hepatitis-B virus and Simian Virus 40 (SV40), or from heterologous mammalian promoters, e.g., the actin promoter or an immunoglobulin promoter, provided such promoters are compatible with the host cell systems, and (2) Regulated expression under control of an inducible vector system, such as ecdysone, tetracycline, etc., provided such promoters are compatible with the host cell systems. Tumor volume is then monitored by caliper measurement at the appearance of palpable tumors and followed over time to determine if 282P1G3-expressing cells grow at a faster rate and whether tumors produced by 282P1G3-expressing cells demonstrate characteristics of altered aggressiveness (e.g. enhanced metastasis, vascularization, reduced responsiveness to chemotherapeutic drugs).

Additionally, mice can be implanted with $1\times10^5$ of the same cells orthotopically to determine if 282P1G3 has an effect on local growth in the pancreas, and whether 282P1G3 affects the ability of the cells to metastasize, specifically to lymph nodes, and bone (Miki, Tet al, Oncol Res. 2001;12:209; Fu X et al, Int J Cancer. 1991, 49:938). The effect of 282P1G3 on bone tumor formation and growth may be assessed by injecting tumor cells intratibially.

The assay is also useful to determine the 282P1G3 inhibitory effect of candidate therapeutic compositions, such as, 282P1G3 intrabodies, 282P1G3 antisense molecules and ribozymes.

Example 38

282P1G3 Monoclonal Antibody-mediated Inhibition of Tumors in Vivo

The significant expression of 282P1G3 in cancer tissues and surface localization, together with its restrictive expression in normal tissues makes 282P1G3 a good target for antibody therapy. Similarly, 282P1G3 is a target for T cell-based immunotherapy. Thus, the therapeutic efficacy of anti-282P1G3 mAbs in human cancer xenograft mouse models, including ovarian, pancreatic or lymphoma and other -282P1G3cancers listed in Table I, is evaluated by using recombinant cell lines such as Pa-1-282P1G3, Panc1-282P1G3, Daudi-282P1G3, and 3T3-282P1G3 (see, e.g., Kaighn, M. E., et al., Invest Urol, 1979. 17(1): 16–23), as well as human xenograft models (Saffran et al PNAS 1999, 10:1073–1078).

Antibody efficacy on tumor growth and metastasis formation is studied, e.g., in a mouse orthotopic ovary, pancreas, or blood cancer xenograft models. The antibodies can be unconjugated, as discussed in this Example, or can be conjugated to a therapeutic modality, as appreciated in the art. Anti-282P1G3 mAbs inhibit formation of tumors in mouse xenografis. Anti-282P1G3 mAbs also retard the growth of established orthotopic tumors and prolonged survival of tumor-bearing mice. These results indicate the utility of anti-282P1G3 mAbs in the treatment of local and advanced stages several solid tumors. (See, e.g., Saffran, D., et al., PNAS 10:1073–1078.

Administration of the anti-282P1G3 mAbs led to retardation of established orthotopic tumor growth and inhibition of metastasis to distant sites, resulting in a significant prolongation in the survival of tumor-bearing mice. These studies indicate that 282P1G3 as an allractive target for immunotherapy and demonstrate the therapeutic potential of anti-282P1G3 mAbs for the treatment of local and metastatic cancer. This example indicates that unconjugated 282P1G3 monoclonal antibodies are effective to inhibit the growth of human pancreatic, ovarian and lymphomas tumor xenografts grown in SCID mice; accordingly a combination of such efficacious monoclonal antibodies is also effective.

Tumor Inhibition Using Multiple Unconjugated 282P1G3 mAbs

Materials and Methods:

282P1G3 Monoclonal Antibodies:

Monoclonal antibodies are raised against 282P1G3 as described in the Example entitled "Generation of 282P1G3 Monoclonal Antibodies (mAbs)." The antibodies are characterized by ELISA, Western blot, FACS, and immunoprecipitation for their capacity to bind 282P1G3. Epitope mapping data for the anti-282P1G3 mAbs, as determined by ELISA and Western analysis, recognize epitopes on the 282P1G3 protein. Immunohistochemical analysis of cancer issues and cells with these antibodies is performed.

The monoclonal antibodies are purified from ascites or hybridoma tissue culture supernatants by Protein-G Sepharose chromatography, dialyzed against PBS, filter sterilized, and stored at −20° C. Protein determinations are performed by a Bradford assay (Bio-Rad, Hercules, Calif.). A therapeutic monoclonal antibody or a cocktail comprising a mixture of individual monoclonal antibodies is prepared and used for the treatment of mice receiving subcutaneous or orthotopic injections of PC3, UM-UC3, CaKi and A427 tumor xenografts.

Cell Lines and Xenografts

The cancer cell lines PA-1, Panc1, Daudi cell lines, as well as the fibroblast line NIH 3T3 (American Type Culture Collection) are maintained in DMEM supplemented with L-glutamine and 10% FBS. PA1-282P1G3, Panc1-282P1G3, Daudi-282P1G3 and 3T3-282P1G3 cell populations are generated by retroviral gene transfer as described in Hubert, R. S., et al., Proc Natl Acad Sci USA, 1999. 96(25): 14523. Human patient-derived xenografts are passaged in 6- to 8-week-old male ICR-severe combined immunodeficient (SCID) mice (Taconic Farms) by s.c. trocar implant (Craft, N., et al., Nat Med. 1999, 5:280). Single-cell suspensions of tumor cells are prepared as described in Craft, et al.

Xenograft Mouse Models.

Subcutaneous (s.c.) tumors are generated by injection of $2\times10^6$ cancer cells mixed at a 1:1 dilution with Matrigel (Collaborative Research) in the right flank of male SCID mice. To test antibody efficacy on tumor formation, i.e. antibody injections are started on the same day as tumor-cell injections. As a control, mice are injected with either purified mouse IgG (ICN) or PBS; or a purified monoclonal antibody that recognizes an irrelevant antigen not expressed in human cells. In preliminary studies, no difference is found between mouse IgG or PBS on tumor growth. Tumor sizes are determined by caliper measurements, and the tumor volume is calculated as length×width×height. Mice with Subcutaneous tumors greater than 1.5 cm in diameter are sacrificed.

Orthotopic injections are performed under anesthesia by using ketamine/xylazine. Following tumor implantation, the mice are segregated into groups for the appropriate treatments, with anti-282P1G3 or control mAbs being injected i.p. To monitor tumor growth, mice are palpated and blood is collected on a weekly basis to measure hCG levels.

Anti-282P1G3 mAbs Inhibit Growth of 282P1G3-Expressing Xenograft-Cancer Tumors

The effect of anti-282P1G3 mAbs on tumor formation is tested by using cell line (e.g. PA-1, Panc1, Daudi and 3T3) and patient-derived tumor orthotopic models. As compared with the s.c. tumor model, the orthotopic model, which requires injection of tumor cells directly in the mouse organ results in a local tumor growth, development of metastasis in distal sites, deterioration of mouse health, and subsequent death (Saffran, D., et al., PNAS supra). The features make the orthotopic model more representative of human disease progression and allowed us to follow the therapeutic effect of mAbs on clinically relevant end points.

A major advantage of the orthotopic cancer models is the ability to study the development of metastases. Formation of metastasis in mice bearing established orthotopic tumors is studies by IHC analysis on lung sections using an antibody against a tumor-specific cell-surface protein such as anti-CK20 for prostate cancer (Lin S et al, Cancer Detect Prev. 2001;25:202).

Another advantage of xenograft cancer models is the ability to study neovascularization and angiogenesis. Tumor growth is partly dependent on new blood vessel development. Although the capillary system and developing blood network is of host origin, the initiation and architecture of the neovasculature is regulated by the xenograft tumor (Davidoff A M et al, Clin Cancer Res. 2001;7:2870; Solesvik O et al., Eur J Cancer Clin Oncol. 1984, 20:1295). The effect of antibody and small molecule on neovascularization is studied in accordance with procedures known in the art, such as by IHC analysis of tumor tissues and their surrounding microenvironment.

Mice bearing established orthotopic tumors are administered 1000 μg injections of either anti-282P1G3 mAb or PBS over a 4-week period. Mice in both groups are allowed to establish a high tumor burden, to ensure a high frequency of metastasis formation in mouse lungs. Mice then are killed and their bladders, livers, bone and lungs are analyzed for the presence of tumor cells by IHC analysis. These studies demonstrate a broad anti-tumor efficacy of anti-282P1G3 antibodies on initiation and progression of prostate cancer in xenograft mouse models. Anti-282P1G3 antibodies inhibit tumor formation of tumors as well as retarding the growth of already established tumors and prolong the survival of treated mice. Moreover, anti-282P1G3 mAbs demonstrate a dramatic inhibitory effect on the spread of local prostate tumor to distal sites, even in the presence of a large tumor burden. Thus, anti-282P1G3 mAbs are efficacious on major clinically relevant end points (tumor growth), prolongation of survival, and health.

Example 39

Therapeutic and Diagnostic Use of Anti-282P1G3 Antibodies in Humans

Anti-282P1G3 monoclonal antibodies are safely and effectively used for diagnostic, prophylactic, prognostic and/or therapeutic purposes in humans. Western blot and immunohistochemical analysis of cancer tissues and cancer xenografts with anti-282P1G3 mAb show strong extensive staining in carcinoma but significantly lower or undetectable levels in normal tissues. Detection of 282P1G3 in carcinoma and in metastatic disease demonstrates the usefulness of the mAb as a diagnostic and/or prognostic indicator. Anti-282P1G3 antibodies are therefore used in diagnostic applications such as immunohistochemistry of kidney biopsy specimens to detect cancer from suspect patients.

As determined by flow cytometry, anti-282P1G3 mAb specifically binds to carcinoma cells. Thus, anti-282P1G3 antibodies are used in diagnostic whole body imaging applications, such as radioimmunoscintigraphy and radioimmunotherapy, (see, e.g., Potamianos S., et. al. Anticancer Res 20(2A):925–948 (2000)) for the detection of localized and metastatic cancers that exhibit expression of 282P1G3. Shedding or release of an extracellular domain of 282P1G3 into the extracellular milieu, such as that seen for alkaline phosphodiesterase B10 (Meerson, N. R., Hepatology 27:563–568 (1998)), allows diagnostic detection of 282P1G3 by anti-282P1G3 antibodies in serum and/or urine sample from suspect patients.

Anti-282P1G3 antibodies that specifically bind 282P1G3 are used in therapeutic applications for the treatment of cancers that express 282P1G3. Anti-282P1G3 antibodies are used as an unconjugated modality and as conjugated from in which the antibodies are attached to one of various therapeutic or imaging modalities well known in the art, such as a prodrugs, enzymes or radioisotopes. In preclinical studies, unconjugated and conjugated anti-282P1G3 antibodies are tested for efficacy of tumor prevention and growth inhibition in the SCID mouse cancer xenograft models, e.g., kidney cancer models AGS-K3 and AGS-K6, (see, e.g., the Example entitled "282P1G3 Monoclonal Antibody-mediated Inhibition of Bladder and Lung Tumors In Vivo"). Either conjugated and unconjugated anti-282P1G3 antibodies are used as a therapeutic modality in human clinical trials either alone or in combination with other treatments as described in following Examples.

Example 40

Human Clinical Trials for the Treatment and Diagnosis of Human Carcinomas through Use of Human Anti-282P1G3 Antibodies in vivo Antibodies are used in accordance with the present invention which recognize an epitope on 282P1G3, and are used in the treatment of certain tumors such as those listed in Table I. Based upon a number of factors, including 282P1G3 expression levels, tumors such as those listed in Table I are presently preferred indications. In connection with each of these indications, three clinical approaches are successfully pursued.

I.) Adjunctive therapy: In adjunctive therapy, patients are treated with anti-282P1G3 antibodies in combination with a chemotherapeutic or antineoplastic agent and/or radiation therapy. Primary cancer targets, such as those listed in Table I, are treated under standard protocols by the addition anti-282P1G3 antibodies to standard first and second line therapy. Protocol designs address effectiveness as assessed by reduction in tumor mass as well as the ability to reduce usual doses of standard chemotherapy. These dosage reductions allow additional and/or prolonged therapy by reducing dose-related toxicity of the chemotherapeutic agent. Anti-282P1G3 antibodies are utilized in several adjunctive clinical trials in combination with the chemotherapeutic or antineoplastic agents adriamycin (advanced prostrate carcinoma), cisplatin (advanced head and neck and lung carcinomas), taxol (breast cancer), and doxorubicin (preclinical).

II.) Monotherapy: In connection with the use of the anti-282P1G3 antibodies in monotherapy of tumors, the antibodies are administered to patients without a chemotherapeutic or antineoplastic agent. In one embodiment, monotherapy is conducted clinically in end stage cancer patients with extensive metastatic disease. Patients show some disease stabilization. Trials demonstrate an effect in refractory patients with cancerous tumors.

III.) Imaging Agent: Through binding a radionuclide (e.g., iodine or yttrium ($I^{131}$, $Y^{90}$) to anti-282P1G3 antibodies, the radiolabeled antibodies are utilized as a diagnostic and/or imaging agent. In such a role, the labeled antibodies localize to both solid tumors, as well as, metastatic lesions of cells expressing 282P1G3. In connection with the use of the anti-282P1G3 antibodies as imaging agents, the antibodies are used as an adjunct to surgical treatment of solid tumors, as both a pre-surgical screen as well as a post-operative follow-up to determine what tumor remains and/or returns. In one embodiment, a ($^{111}In$)-282P1G3 antibody is used as an imaging agent in a Phase I human clinical trial in patient having a carcinoma that expresses 282P1G3 (by analogy see, e.g., Divgi et al. *J. Natl. Cancer Inst.* 83:97–104 (1991)). Patients are followed with standard anterior and posterior gamma camera. The results indicate that primary lesions and metastatic lesions are identified.

Dose and Route of Administration

As appreciated by those of ordinary skill in the art, dosing considerations can be determined through comparison with the analogous products that are in the clinic. Thus, anti-282P1G3 antibodies can be administered with doses in the range of 5 to 400 mg/$m^2$, with the lower doses used, e.g., in connection with safety studies. The affinity of anti-282P1G3 antibodies relative to the affinity of a known antibody for its target is one parameter used by those of skill in the art for determining analogous dose regimens. Further, anti-282P1G3 antibodies that are fully human antibodies, as compared to the chimeric antibody, have slower clearance; accordingly, dosing in patients with such fully human anti-282P1G3 antibodies can be lower, perhaps in the range of 50 to 300 mg/$m^2$, and still remain efficacious. Dosing in mg/$m^2$, as opposed to the conventional measurement of dose in mg/kg, is a measurement based on surface area and is a convenient dosing measurement that is designed to include patients of all sizes from infants to adults.

Three distinct delivery approaches are useful for delivery of anti-282P1G3 antibodies. Conventional intravenous delivery is one standard delivery technique for many tumors. However, in connection with tumors in the peritoneal cavity, such as tumors of the ovaries, biliary duct, other ducts, and the like, intraperitoneal administration may prove favorable for obtaining high dose of antibody at the tumor and to also minimize antibody clearance. In a similar manner, certain solid tumors possess vasculature that is appropriate for regional perfusion. Regional perfusion allows for a high dose of antibody at the site of a tumor and minimizes short term clearance of the antibody.

Clinical Development Plan (CDP)

Overview: The CDP follows and develops treatments of anti-282P1G3 antibodies in connection with adjunctive therapy, monotherapy, and as an imaging agent. Trials initially demonstrate safety and thereafter confirm efficacy in repeat doses. Trails are open label comparing standard chemotherapy with standard therapy plus anti-282P1G3 antibodies. As will be appreciated, one criteria that can be utilized in connection with enrollment of patients is 282P1G3 expression levels in their tumors as determined by biopsy.

As with any protein or antibody infusion-based therapeutic, safety concerns are related primarily to (i) cytokine release syndrome, i.e., hypotension, fever, shaking, chills; (ii) the development of an immunogenic response to the material (i.e., development of human antibodies by the patient to the antibody therapeutic, or HAHA response); and, (iii) toxicity to normal cells that express 282P1G3. Standard tests and follow-up are utilized to monitor each of these safety concerns. Anti-282P1G3 antibodies are found to be safe upon human administration.

Example 41

Human Clinical Trial Adjunctive Therapy with Human Anti-282P1G3 Antibody and Chemotherapeutic Agent A phase I human clinical trial is initiated to assess the safety of six intravenous doses of a human anti-282P1G3 antibody in connection with the treatment of a solid tumor, e.g., a cancer of a tissue listed in Table I. In the study, the safety of single doses of anti-282P1G3 antibodies when utilized as an adjunctive therapy to an antineoplastic or chemotherapeutic agent as defined herein, such as, without limitation: cisplatin, topotecan, doxorubicin, adriamycin, taxol, or the like, is assessed. The trial design includes delivery of six single doses of an anti-282P1G3 antibody with dosage of antibody escalating from approximately about 25 mg/m$^2$ to about 275 mg/m$^2$ over the course of the treatment in accordance with the following schedule:

| | Day 0 | Day 7 | Day 14 | Day 21 | Day 28 | Day 35 |
|---|---|---|---|---|---|---|
| mAb Dose | 25 mg/m$^2$ | 75 mg/m$^2$ | 125 mg/m$^2$ | 175 mg/m$^2$ | 225 mg/m$^2$ | 275 mg/m$^2$ |
| Chemotherapy (standard dose) | + | + | + | + | + | + |

Patients are closely followed for one-week following each administration of antibody and chemotherapy. In particular, patients are assessed for the safety concerns mentioned above: (i) cytokine release syndrome, i.e., hypotension, fever, shaking, chills; (ii) the development of an immunogenic response to the material (i.e., development of human antibodies by the patient to the human antibody therapeutic, or HAHA response); and, (iii) toxicity to normal cells that express 282P1G3. Standard tests and follow-up are utilized to monitor each of these safety concerns. Patients are also assessed for clinical outcome, and particularly reduction in tumor mass as evidenced by MRI or other imaging.

The anti-282P1G3 antibodies are demonstrated to be safe and efficacious, Phase II trials confirm the efficacy and refine optimum dosing.

Example 42

Human Clinical Trial: Monotherapy with Human Anti-282P1G3 Antibody

Anti-282P1G3 antibodies are safe in connection with the above-discussed adjunctive trial, a Phase II human clinical trial confirms the efficacy and optimum dosing for monotherapy. Such trial is accomplished, and entails the same safety and outcome analyses, to the above-described adjunctive trial with the exception being that patients do not receive chemotherapy concurrently with the receipt of doses of anti-282P1G3 antibodies.

Example 43

Human Clinical Trial: Diagnostic Imaging with Anti-282P1G3 Antibody

Once again, as the adjunctive therapy discussed above is safe within the safety criteria discussed above, a human clinical trial is conducted concerning the use of anti-282P1G3 antibodies as a diagnostic imaging agent. The protocol is designed in a substantially similar manner to those described in the art, such as in Divgi et al. *J. Natl. Cancer Inst.* 83:97–104 (1991). The antibodies are found to be both safe and efficacious when used as a diagnostic modality.

Example 44

Homology Comparison of 282P1G3 to Known Sequences

The human 282P1G3 protein exhibit a high degree of homology to a known human protein, cell adhesion molecule with homology to L1CAM precursor (gi 27894376), also known Close Homolog of L1 (CHL1) or CALL. Human CHL1 shows 99% identity to 282P1G3 at the protein level (FIG. 4A). The mouse homolog of 282P1G3 has been identified as murine CHL1 (gi 6680936), and shows 82% identity and 89% homology to 282P1G3 (FIG. 4B). CHL1 has been reported to regulate neuronal development by altering cell adhesion and axonal projections (Montag-Sallaz M et al, Mol. Cell. Biol. 2002, 22:7967). In addition, CHL1 was found to play a role in neurite growth and survival (Dong L et al, J. Neurosci. Res, 2002; Chaisuksunt V et al, J. Comp. Neurol 2000, 425:382). Mutations in CHL1 have been associated with schizophrenia and metal disorders (Sakurai et al, Mol Psychiatry 2002, 7:412; We H et al, Hum Genet 1998, 103:355).

The prototype member of the 282P1G3 family, 282P1G3v.1, is a 1224 amino acids protein. Initial bioinformatics analysis using topology prediction programs suggested that 191P2D14 may contain 2 transmembranes based on hydrophobicity profile. However, the first hydrophobic domain was identified as a signal sequence, rendering 191P2D12 a single transmembrane protein.

The 282P1G3 gene has several variants, including 5 SNP represented by 282P1G3 v.9, v.10, v.11, v.24 and v.25. In addition, several splice variants have been identified, including deletion variants such as 282P1G3 v.2, v.4, v.5 and v.6, as well as insertion mutants such as 282P1G3 v.7 and v.8, and a splice variant at aa 838 of 282P1G3 v.1, namely 282P1G3 v.3.

Motif analysis revealed the presence of several protein functional motifs in the 282P1G3 protein (Table L). Six immunoglobulin domains have been identified in addition to four fibronectin type III repeats. Immunoglobulin domains are found in numerous proteins and participate in protein-protein such including protein-ligand interactions (Weismann et al, J Mol Med 2000, 78:247). In addition, Ig-domains function in cell adhesion, allowing the interaction of leukocytes and blood-born cells with the endothelium (Wang and Springer, Immunol Rev 1998, 163:197). Fibronectin type III repeats are 100 amino acid domains with binding sites for various molecules, including DNA, heparin, basement membrane and cell surface proteins (Kimizuka et al, J Biol Chem. 1991, 266:3045; Yokosaki et al, J Biol Chem. 1998, 273:11423). The majority for proteins containing fibronectin IIII motifs participate in cell surface binding, binding to specific substrates including heparin, collagen, DNA, actin and fibrin, or are involved in binding to fibronectin receptors. Fibronectins have been reported to function in wound healing; cell adhesion, cell differentiation, cell migration and tumour metastasis (Bloom et al, Mol Biol Cell. 1999, 10:1521; Brodt P. Cancer Met Rev 1991, 10:23). The motifs found in 282P1G3 as well as its similarity to CHL1 indicate that 282P1G3 can participate in tumor growth and progression by enhancing the initial stages of tumorigenesis, including tumor establishment and tumor growth, by allowing adhesion to basement membranes and surrounding cells, by mediating cell migration and metastasis.

Accordingly, when 282P1G3 functions as a regulator of tumor establishment, tumor formation, tumor growth, survival or cell signaling, 282P1G3 is used for therapeutic, diagnostic, prognostic and/or preventative purposes. In addition when a molecule, such as a splice variant or SNP of 282P1G3 is expressed in cancerous tissues, such as those listed in Table I, they are used for therapeutic, diagnostic, prognostic and/or preventative purposes.

Example 45

Regulation of Transcription

The cell surface localization of 282P1G3 coupled to the presence of Ig-domains within its sequence indicate that 282P1G3 modulates signal transduction and the transcriptional regulation of eukaryotic genes. Regulation of gene expression is confirmed, e.g., by studying gene expression in cells expressing or lacking 282P1G3. For this purpose, two types of experiments are performed.

In the first set of experiments, RNA from parental and 282P1G3-expressing cells are extracted and hybridized to commercially available gene arrays (Clontech) (Smid-Koopman E et al. Br J Cancer. 2000. 83:246). Resting cells as well as cells treated with FBS, androgen or growth factors are compared. Differentially expressed genes are identified in accordance with procedures known in the art. The differentially expressed genes are then mapped to biological pathways (Chen K et al. Thyroid. 2001. 11:41.).

In the second set of experiments, specific transcriptional pathway activation is evaluated using commercially available (Stratagene) luciferase reporter constructs including: NFkB-luc, SRE-luc, ELK1-luc, ARE-luc, p53-luc, and CRE-luc. These transcriptional reporters contain consensus binding sites for known transcription factors that lie downstream of well-characterized signal transduction pathways, and represent a good tool to ascertain pathway activation and screen for positive and negative modulators of pathway activation.

Thus, 282P1G3 plays a role in gene regulation, and it is used as a target for diagnostic, prognostic, preventative and/or therapeutic purposes.

Example 46

Identification and Confirmation of Potential Signal Transduction Pathways

Many mammalian proteins have been reported to interact with signaling molecules and to participate in regulating signaling pathways. (J Neurochem. 2001; 76:217–223). Immunoglobulin-like molecules in particular has been associated with several tyrpsine kinases including Lyc, Blk, syk (Tamir and Cambier, Oncogene. 1998, 17:1353), the MAPK signaling cascade that control cell mitogenesis and calcium flux (Vilen J et al, J Immunol 1997, 159:231; Jiang F, Jia Y, Cohen I. Blood. 2002, 99:3579). In addition, the 282P1G3 protein contains several phosphorylation sites (see Table VI) indicating an association with specific signaling cascades. Using immunoprecipitation and Western blotting techniques, proteins are identified that associate with 282P1G3 and mediate signaling events. Several pathways known to play a role in cancer biology can be regulated by 282P1G3, including phospholipid pathways such as PI3K, AKT, etc, adhesion and migration pathways, including FAK, Rho, Rac-1, catenin, etc, as well as mitogenic/survival cascades such as ERK, p38, etc (Cell, Growth Differ. 2000,11:279; J Biol Chem. 1999, 274:801; Oncogene. 2000, 19:3003, J. Cell Biol. 1997, 138:913.).). In order to determine whether expression of 282P1G3 is sufficient to regulate specific signaling pathways not otherwise active in resting cancer cells, the effect of 282P1G3 on the activation of the signaling cascade is investigated in the cancer cell PA-1, Panc1 and Daudi. Cancer cells stably expressing 282P1G3 or neo are stimulated with growth factor, FBS or other activating molecules. Whole cell lysates are analyzed by western blotting.

To confirm that 282P1G3 directly or indirectly activates known signal transduction pathways in cells, luciferase (luc) based transcriptional reporter assays are carried out in cells expressing individual genes. These transcriptional reporters contain consensus-binding sites for known transcription factors that lie downstream of well-characterized signal transduction pathways. The reporters and examples of these associated transcription factors, signal transduction pathways, and activation stimuli are listed below.

1. NFkB-luc, NFkB/Rel; Ik-kinase/SAPK; growth/apoptosis/stress
2. SRE-luc, SRF/TCF/ELK1; MAPK/SAPK; growth/differentiation
3. AP-1-luc, FOS/JUN; MAPK/SAPK/PKC; growth/apoptosis/stress
4. ARE-luc, androgen receptor; steroids/MAPK; growth/differentiation/apoptosis
5. p53-luc, p53; SAPK; growth/differentiation/apoptosis
6. CRE-luc, CREB/ATF2; PKA/p38; growth/apoptosis/stress
7. TCF-luc, TCF/Lef; -catenin, Adhesion/invasion Gene-mediated effects can be assayed in cells showing mRNA expression. Luciferase reporter plasmids can be introduced by lipid-mediated transfection (TFX-50, Promega). Luciferase activity, an indicator of relative transcriptional activity, is measured by incubation of cell extracts with luciferin substrate and luminescence of the reaction is monitored in a luminometer.

Signaling pathways activated by 282P1G3 are mapped and used for the identification and validation of therapeutic targets. When 282P1G3 is involved in cell signaling, it is used as target for diagnostic, prognostic, preventative and/or therapeutic purposes.

Example 47

Involvement in Tumor Progression

Based on the role of Ig-domains and fibronectin motifs in cell growth and signal transduction, the 282P1G3 gene can contribute to the growth, invasion and transformation of cancer cells. The role of 282P1G3 in tumor growth is confirmed in a variety of primary and transfected cell lines including prostate cell lines, as well as NIH 3T3 cells engineered to stably express 282P1G3. Parental cells lacking 282P1G3 and cells expressing 282P1G3 are evaluted for cell growth using a well-documented proliferation assay (Fraser S P, Grimes J A, Djamgoz M B. Prostate. 2000;44: 61, Johnson D E, Ochieng J, Evans S L. Anticancer Drugs. 1996, 7:288).

To confirm the role of 282P1G3 in the transformation process, its effect in colony forming assays is investigated. Parental NIH-3T3 cells lacking 282P1G3 are compared to NIH-3T3 cells expressing 282P1G3, using a soft agar assay under stringent and more permissive conditions (Song Z. et al. Cancer Res. 2000;60:6730).

To confirm the role of 282P1G3 in invasion and metastasis of cancer cells, a well-established assay is used, e.g., a Transwell Insert System assay (Becton Dickinson) (Cancer Res. 1999; 59:6010). Control cells, including prostate, breast and kidney cell lines lacking 282P1G3 are compared to cells expressing 282P1G3. Cells are loaded with the fluorescent dye, calcein, and plated in the top well of the Transwell insert coated with a basement membrane analog. Invasion is determined by fluorescence of cells in the lower chamber relative to the fluorescence of the entire cell population.

282P1G3 can also play a role in cell cycle and apoptosis. Parental cells and cells expressing 282P1G3 are compared for differences in cell cycle regulation using a well-established BrdU assay (Abdel-Malek Z A. J Cell Physiol. 1988, 136:247). In short, cells are grown under both optimal (full serum) and limiting (low serum) conditions are labeled with BrdU and stained with anti-BrdU Ab and propidium iodide. Cells are analyzed for entry into the G1, S, and G2M phases of the cell cycle. Alternatively, the effect of stress on apoptosis is evaluated in control parental cells and cells expressing 282P1G3, including normal and tumor prostate cells. Engineered and parental cells are treated with various chemotherapeutic agents, such as etoposide, taxol, etc, and protein synthesis inhibitors, such as cycloheximide. Cells are stained with annexin V-FITC and cell death is measured by FACS analysis. The modulation of cell death by 282P1G3 can play a critical role in regulating tumor progression and tumor load.

When 282P1G3 plays a role in cell growth, transformation, invasion or apoptosis, it is used as a target for diagnostic, prognostic, preventative and/or therapeutic purposes.

Example 48

Involvement in Angiogenesis

Angiogenesis or new capillary blood vessel formation is necessary for tumor growth (Hanahan D, Folkman J. Cell. 1996, 86:353; Folkman J. Endocrinology. 1998 139:441). Based on the effect of fibronectins on tumor cell adhesion and their interaction with endothelial cells, 282P1G3 plays a role in angiogenesis (Mareel and Leroy: Physiol Rev, 83:337; DeFouw L et al, Microvasc Res 2001, 62:263). Several assays have been developed to measure angiogenesis in vitro and in vivo, such as the tissue culture assays endothelial cell tube formation and endothelial cell proliferation. Using these assays as well as in vitro neo-vascularization, the role of 282P1G3 in angiogenesis, enhancement or inhibition, is confirmed.

For example, endothelial cells engineered to express 282P1G3 are evaluated using tube formation and proliferation assays. The effect of 282P1G3 is also confirmed in animal models in vivo. For example, cells either expressing or lacking 282P1G3 are implanted subcutaneously in immunocompromised mice. Endothelial cell migration and angiogenesis are evaluated 5–15 days later using immunohistochemistry techniques. 282P1G3 affects angiogenesis, and it is used as a target for diagnostic, prognostic, preventative and/or therapeutic purposes.

Example 49

Involvement in Protein-Protein Interactions

Ig-domains and fibronectin motifs have been shown to mediate interaction with other proteins, including cell surface protein. Using immunoprecipitation techniques as well as two yeast hybrid systems, proteins are identified that associate with 282P1G3. Immunoprecipitates from cells expressing 282P1G3 and cells lacking 282P1G3 are compared for specific protein-protein associations.

Studies are performed to confirm the extent of association of 282P1G3 with effector molecules, such as nuclear proteins, transcription factors, kinases, phosphates etc. Studies comparing 282P1G3 positive and 282P1G3 negative cells as well as studies comparing unstimulated/resting cells and cells treated with epithelial cell activators, such as cytokines, growth factors, androgen and anti-integrin Ab reveal unique interactions.

In addition, protein-protein interactions are confirmed using two yeast hybrid methodology (Curr. Opin. Chem. Biol. 1999, 3:64). A vector carrying a library of proteins fused to the activation domain of a transcription factor is introduced into yeast expressing a 282P1G3-DNA-binding domain fusion protein and a reporter construct. Protein-protein interaction is detected by calorimetric reporter activity. Specific association with effector molecules and transcription factors directs one of skill to the mode of action of 282P1G3, and thus identifies therapeutic, prognostic, preventative and/or diagnostic targets for cancer. This and similar assays are also used to identify and screen for small molecules that interact with 282P1G3.

Thus, it is found that 282P1G3 associates with proteins and small molecules. Accordingly, 282P1G3 and these proteins and small molecules are used for diagnostic, prognostic, preventative and/or therapeutic purposes.

Example 50

Involvement of 282P1G3 in Cell-Cell Communication

Cell—cell communication is essential in maintaining organ integrity and homeostasis, both of which become deregulated during tumor formation and progression. Based on the presence of a fibronectin motif in 282P1G3, a motif known to be involved in cell interaction and cell-cell adhesion, 282P1G3 can regulate cell communication. Intercellular communications can be measured using two types of assays (J. Biol. Chem. 2000, 275:25207). In the first assay, cells loaded with a fluorescent dye are incubated in the presence of unlabeled recipient cells and the cell populations are examined under fluorescent microscopy. This qualitative assay measures the exchange of dye between adjacent cells. In the second assay system, donor and recipient cell populations are treated as above and quantitative measurements of the recipient cell population are performed by FACS analysis. Using these two assay systems, cells expressing 282P1G3 are compared to controls that do not express 282P1G3, and it is found that 282P1G3 enhances cell communications. Small molecules and/or antibodies that modulate cell-cell communication mediated by 282P1G3 are used as therapeutics for cancers that express 282P1G3. When 282P1G3 functions in cell-cell communication and small molecule transport, it is used as a target or marker for diagnostic, prognostic, preventative and/or therapeutic purposes.

Throughout this application, various website data content, publications, patent applications and patents are referenced. (Websites are referenced by their Uniform Resource Locator, or URL, addresses on the World Wide Web.) The disclosures of each of these references are hereby incorporated by reference herein in their entireties.

The present invention is not to be limited in scope by the embodiments disclosed herein, which are intended as single illustrations of individual aspects of the invention, and any that are functionally equivalent are within the scope of the invention. Various modifications to the models and methods of the invention, in addition to those described herein, will become apparent to those skilled in the art from the foregoing description and teachings, and are similarly intended to fall within the scope of the invention. Such modifications or other embodiments can be practiced without departing from the true scope and spirit of the invention.

TABLE I

| Tissues that Express 282P1G3: |
|---|
| a. Malignant Tissues |
| Pancreas |
| Ovary |
| Lymph node |

TABLE II

Amino Acid Abbreviations

| SINGLE LETTER | THREE LETTER | FULL NAME |
|---|---|---|
| F | Phe | phenylalanine |
| L | Leu | leucine |
| S | Ser | serine |
| Y | Tyr | tyrosine |
| C | Cys | cysteine |
| W | Trp | tryptophan |
| P | Pro | proline |
| H | His | histidine |
| Q | Gln | glutamine |
| R | Arg | arginine |
| I | Ile | isoleucine |
| M | Met | methionine |
| T | Thr | threonine |
| N | Asn | asparagine |
| K | Lys | lysine |
| V | Val | valine |
| A | Ala | alanine |
| D | Asp | aspartic acid |
| E | Glu | glutamic acid |
| G | Gly | glycine |

TABLE III

Amino Acid Substitution Matrix
Adapted from the GCG Software 9.0 BLOSUM62 amino acid substitution matrix (block substitution matrix). The higher the value, the more likely a substitution is found in related, natural proteins.
(See world wide web URL ikp.unibe.ch/manual/blosum62.html)

| A | C | D | E | F | G | H | I | K | L | M | N | P | Q | R | S | T | V | W | Y | . |
|---|---|---|---|---|---|---|---|---|---|---|---|---|---|---|---|---|---|---|---|---|
| 4 | 0 | −2 | −1 | −2 | 0 | −2 | −1 | −1 | −1 | −1 | −2 | −1 | −1 | −1 | 1 | 0 | 0 | −3 | −2 | A |
| | 9 | −3 | −4 | −2 | −3 | −3 | −1 | −3 | −1 | −1 | −3 | −3 | −3 | −3 | −1 | −1 | −1 | −2 | −2 | C |
| | | 6 | 2 | −3 | −1 | −1 | −3 | −1 | −4 | −3 | 1 | −1 | 0 | −2 | 0 | −1 | −3 | −4 | −3 | D |
| | | | 5 | −3 | −2 | 0 | −3 | 1 | −3 | −2 | 0 | −1 | 2 | 0 | 0 | −1 | −2 | −3 | −2 | E |
| | | | | 6 | −3 | −1 | 0 | −3 | 0 | 0 | −3 | −4 | −3 | −3 | −2 | −2 | −1 | 1 | 3 | F |
| | | | | | 6 | −2 | −4 | −2 | −4 | −3 | 0 | −2 | −2 | −2 | 0 | −2 | −3 | −2 | −3 | G |
| | | | | | | 8 | −3 | −1 | −3 | −2 | 1 | −2 | 0 | 0 | −1 | −2 | −3 | −2 | 2 | H |
| | | | | | | | 4 | −3 | 2 | 1 | −3 | −3 | −3 | −3 | −2 | −1 | 3 | −3 | −1 | I |
| | | | | | | | | 5 | −2 | −1 | 0 | −1 | 1 | 2 | 0 | −1 | −2 | −3 | −2 | K |
| | | | | | | | | | 4 | 2 | −3 | −3 | −2 | −2 | −2 | −1 | 1 | −2 | −1 | L |
| | | | | | | | | | | 5 | −2 | −2 | 0 | −1 | −1 | −1 | 1 | −1 | −1 | M |
| | | | | | | | | | | | 6 | −2 | 0 | 0 | 1 | 0 | −3 | −4 | −2 | N |
| | | | | | | | | | | | | 7 | −1 | −2 | −1 | −1 | −2 | −4 | −3 | P |
| | | | | | | | | | | | | | 5 | 1 | 0 | −1 | −2 | −2 | −1 | Q |
| | | | | | | | | | | | | | | 5 | −1 | −1 | −3 | −3 | −2 | R |
| | | | | | | | | | | | | | | | 4 | 1 | −2 | −3 | −2 | S |
| | | | | | | | | | | | | | | | | 5 | 0 | −2 | −2 | T |
| | | | | | | | | | | | | | | | | | 4 | −3 | −1 | V |
| | | | | | | | | | | | | | | | | | | 11 | 2 | W |
| | | | | | | | | | | | | | | | | | | | 7 | Y |

TABLE IV

| HLA Class I/II Motifs/Supermotifs |
|---|

TABLE IV (A)

HLA Class I Supermotifs/Motifs

| | POSITION 2 (Primary Anchor) | POSITION 3 (Primary Anchor) | POSITION C Terminus (Primary Anchor) |
|---|---|---|---|
| SUPERMOTIF | | | |
| A1 | **TI***LVMS* | | **FWY** |
| A2 | **LIVM***ATQ* | | **IV***MATL* |
| A3 | **VSMA***TLI* | | **RK** |
| A24 | **YF***WIVLMT* | | **FI***YWLM* |
| B7 | **P** | | **VILF***MWYA* |
| B27 | **RHK** | | **FYLWMIVA** |
| B44 | **E***D* | | **FWY***LIMVA* |
| B58 | **ATS** | | **FWY***LIVMA* |
| B62 | **QL***IVMP* | | **FWY***MIVLA* |
| MOTIFS | | | |
| A1 | **TSM** | | **Y** |
| A1 | | **DE***AS* | **Y** |
| A2.1 | **LM***VQIAT* | | **V***LIMAT* |
| A3 | **LMVISATF***CGD* | | **KYR***HFA* |
| A11 | **VTMLISAGN***CDF* | | **K***RYH* |
| A24 | **YF***WM* | | **FLIW** |
| A*3101 | **MVT***ALIS* | | **RK** |
| A*3301 | **MVALF***IST* | | **RK** |
| A*6801 | **AVT***MSLI* | | **RK** |

TABLE IV (A)-continued

HLA Class I Supermotifs/Motifs

| | POSITION 2 (Primary Anchor) | POSITION 3 (Primary Anchor) | POSITION C Terminus (Primary Anchor) |
|---|---|---|---|
| B*0702 | **P** | | **LMF***WYAIV* |
| B*3501 | **P** | | **LMFWY***IVA* |
| B51 | **P** | | **LIVF***WYAM* |
| B*5301 | **P** | | **IMFWY***ALV* |
| B*5401 | **P** | | **ATIV***LMFWY* |

Bolded residues are preferred, italicized residues are less preferred: A peptide is considered motif-bearing if it has primary anchors at each primary anchor position for a motif or supermotif as specified in the above table.

TABLE IV (B)

HLA Class II Supermotif

| 1 | 6 | 9 |
|---|---|---|
| W, F, Y, V, I, L | A, V, I, L, P, C, S, T | A, V, I, L, C, S, T, M, Y |

TABLE IV (C)

HLA Class II Motifs

| MOTIFS | | 1° anchor 1 | 2 | 3 | 4 | 5 | 1° anchor 6 | 7 | 8 | 9 |
|---|---|---|---|---|---|---|---|---|---|---|
| DR4 | preferred | FMY*LIVW* | M | T | | I | VST*CPALIM* | MH | | MH |
| | deleterious | | | | W | | | R | | WDE |
| DR1 | preferred | MF*LIVWY* | | | PAMQ | | VMAT*SPLIC* | M | | AVM |
| | deleterious | | C | CH | FD | CWD | | GDE | D | |
| DR7 | preferred | MF*LIVWY* | M | W | A | | IVMSA*CTPL* | M | | IV |
| | deleterious | | C | | G | | | GRD | N | G |

| DR3 MOTIFS | 1° anchor 1 | 2 | 3 | 1° anchor 4 | 5 | 1° anchor 6 |
|---|---|---|---|---|---|---|
| Motif a preferred | LIVMFY | | | D | | |
| Motif b preferred | LIVMFAY | | | DNQEST | | KRH |
| DR Supermotif | MF*LIVWY* | | | | | VMSTA*CPLI* |

Italicized residues indicate less preferred or "tolerated" residues

TABLE IV (D)

HLA Class I Supermotifs

| SUPER-MOTIFS | | POSITION: 1 | 2 | 3 | 4 | 5 | 6 | 7 | 8 | C-terminus |
|---|---|---|---|---|---|---|---|---|---|---|
| A1 | | | 1° Anchor TI*LVMS* | | | | | | | 1° Anchor FWY |
| A2 | | | 1° Anchor LIV*MATQ* | | | | | | | 1° Anchor LIVMAT |
| A3 | Preferred | | 1° Anchor VSMA*TLI* | YFW (4/5) | | | YFW (3/5) | YFW (4/5) | P (4/5) | 1° Anchor RK |
| | deleterious | DE(3/5); P(5/5) | | DE (4/5) | | | | | | |

TABLE IV (D)-continued

HLA Class I Supermotifs

| SUPER-MOTIFS | | POSITION: 1 | 2 | 3 | 4 | 5 | 6 | 7 | 8 | C-terminus |
|---|---|---|---|---|---|---|---|---|---|---|
| A24 | | | 1° Anchor YF*WIVLMT* | | | | | | | 1° Anchor FIY*WLM* |
| B7 | Preferred | FWY(5/5) LIVM(3/5) | 1° Anchor P | FWY (4/5) | | | | | FWY (3/5) | 1° Anchor VILF*MWYA* |
| | deleterious | DE(3/5); P(5/5); G(4/5); A(3/5); QN(3/5) | | | | DE (3/5) | G (4/5) | QN (4/5) | DE (4/5) | |
| B27 | | | 1° Anchor RHK | | | | | | | 1° Anchor FYL*WMIVA* |
| B44 | | | 1° Anchor E*D* | | | | | | | 1° Anchor FWYLIMVA |
| B58 | | | 1° Anchor ATS | | | | | | | 1° Anchor FWY*LIVMA* |
| B62 | | | 1° Anchor QL*IVMP* | | | | | | | 1° Anchor FWY*MIVLA* |

Italicized residues indicate less preferred or "tolerated" residues

TABLE IV (E)

HLA Class I Motifs

| | | POSITION 1 | 2 | 3 | 4 | 5 | 6 | 7 | 8 | 9 or C-terminus | C-terminus |
|---|---|---|---|---|---|---|---|---|---|---|---|
| A1 9-mer | preferred | GFYW | 1° Anchor STM | DEA | YFW | | P | DEQN | YFW | 1° Anchor Y | |
| | deleterious | DE | | RHKLIVMP | A | G | A | | | | |
| A1 9-mer | preferred | GRHK | ASTCLIVM | 1° Anchor DE*AS* | GSTC | | ASTC | LIVM | DE | 1° Anchor Y | |
| | deleterious | A | RHKDEPYFW | | DE | PQN | RHK | PG | GP | | |
| A1 10-mer | preferred | YFW | 1° Anchor STM | DEAQN | A | YFWQN | | PASTC | GDE | P | 1° Anchor Y |
| | deleterious | GP | | RHKGLIVM | DE | RHK | QNA | RHKYFW | RHK | A | |
| A1 10-mer | preferred | YFW | STCLIVM | 1° Anchor DE*AS* | A | YFW | | PG | G | YFW | 1° Anchor Y |
| | deleterious | RHK | RHKDEPYFW | | | P | G | | PRHK | QN | |
| A2.1 9-mer | preferred | YFW | 1° Anchor LM*IVQAT* | YFW | STC | YFW | | A | P | 1° Anchor V*LIMAT* | |
| | deleterious | DEP | | DERKH | | | RKH | DERKH | | | |

| | | POSITION: 1 | 2 | 3 | 4 | 5 | 6 | 7 | 8 | 9 | C-terminus |
|---|---|---|---|---|---|---|---|---|---|---|---|
| A2.1 10-mer | preferred | AYFW | 1° Anchor LM*IVQAT* | LVIM | G | | G | | FYWLVIM | | 1° Anchor V*LIMAT* |
| | deleterious | DEP | | DE | RKHA | P | | RKH | DERKH | RKH | |
| A3 | preferred | RHK | 1° Anchor LMVISATF*CGD* | YFW | PRHKYFW | A | YFW | | P | 1° Anchor KYR*HFA* | |
| | deleterious | DEP | | DE | | | | | | | |
| A11 | preferred | A | 1° Anchor VTLMISAGN*CDF* | YFW | YFW | A | YFW | YFW | P | 1° Anchor K*RYH* | |
| | deleterious | DEP | | | | | | A | G | | |
| A24 9-mer | preferred | YFWRHK | 1° Anchor YFW*M* | | STC | | | YFW | YFW | 1° Anchor FLIW | |
| | deleterious | DEG | | DE | G | QNP | DERHK | G | AQN | | |
| A24 10-mer | Preferred | | 1° Anchor YFW*M* | | P | YFWP | | P | | | 1° Anchor FLIW |

TABLE IV (E)-continued

HLA Class I Motifs

| | | | | | | | | | | | |
|---|---|---|---|---|---|---|---|---|---|---|---|
| | Deleterious | | | GDE | QN | RHK | DE | A | QN | DEA | |
| A3101 | Preferred | RHK | 1° Anchor MVT*ALIS* | YFW | P | | YFW | YFW | AP | 1° Anchor R*K* | |
| | Deleterious | DEP | | DE | | ADE | DE | DE | DE | | |
| A3301 | Preferred | | 1° Anchor MVALF*IST* | YFW | | | | AYFW | | 1° Anchor RK | |
| | Deleterious | GP | | DE | | | | | | | |
| A6801 | Preferred | YFWSTC | 1° Anchor AVT*MSLI* | | | YFW LIVM | | YFW | P | 1° Anchor RK | |
| | Deleterious | GP | | DEG | | RHK | | | A | | |
| B0702 | Preferred | RHKFWY | 1° Anchor P | RHK | | RHK | RHK | RHK | PA | 1° Anchor LMF*WY AIV* | |
| | Deleterious | DEQNP | | DEP | DE | DE | GDE | QN | DE | | |
| B3501 | Preferred | FWYLIVM | 1° Anchor P | FWY | | | | FWY | | 1° Anchor LMF*WYIVA* | |
| | deleterious | AGP | | | | G | G | | | | |
| | | POSITION: | | | | | | | | | |
| | | 1 | 2 | 3 | 4 | 5 | 6 | 7 | 8 | 9 or C-terminus | C-terminus |
| A1 9-mer | preferred | GFYW | 1° Anchor STM | DEA | YFW | | P | DEQN | YFW | 1° Anchor Y | |
| | deleterious | DE | | RHKLIVMP | A | G | A | | | | |
| A1 9-mer | preferred | GRHK | ASTCLIVM | 1° Anchor DE*AS* | GSTC | | A STC | LIVM | DE | 1° Anchor Y | |
| | deleterious | A | RHKDEP YFW | | DE | PQN | RHK | PG | GP | | |
| | deleterious | AGP | | | | G | G | | | | |
| B51 | Preferred | LIVMFWY | 1° Anchor P | FWY | STC | FWY | | G | FWY | 1° Anchor LIVF*WYAM* | |
| | deleterious | AGPDERHKSTC | | | | DE | G | DEQN | GDE | | |
| B5301 | preferred | LIVMFWY | 1° Anchor P | FWY | STC | FWY | | LIVM FWY | FWY | 1° Anchor IMFW*YALV* | |
| | deleterious | AGPQN | | | | | G | RHKQN | DE | | |
| B5401 | preferred | FWY | 1° Anchor P | FWYLIVM | | LIVM | | ALIVM | FWYAP | 1° Anchor ATIV*LMFWY* | |
| | deleterious | GPQNDE | | GDESTC | | RHKDE | DE | QNDGE | DE | | |

TABLE IV (F)

Summary of HLA-supertypes
Overall phenotypic frequencies of HLA-supertypes in different ethnic populations

| Specificity | | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| B7 | P | AILMVFWY | 43.2 | 55.1 | 57.1 | 43.0 | 49.3 | 49.5 |
| A3 | AILMVST | RK | 37.5 | 42.1 | 45.8 | 52.7 | 43.1 | 44.2 |

TABLE IV (F)-continued

Summary of HLA-supertypes
Overall phenotypic frequencies of HLA-supertypes in different ethnic populations

| Specificity | | | Phenotypic frequency | | | | | |
|---|---|---|---|---|---|---|---|---|
| Supertype | Position 2 | C-Terminus | Caucasian | N.A. Black | Japanese | Chinese | Hispanic | Average |
| A2 | AILMVT | AILMVT | 45.8 | 39.0 | 42.4 | 45.9 | 43.0 | 42.2 |
| A24 | YF (WIVLMT) | FI (YWLM) | 23.9 | 38.9 | 58.6 | 40.1 | 38.3 | 40.0 |
| B44 | E (D) | FWYLIMVA | 43.0 | 21.2 | 42.9 | 39.1 | 39.0 | 37.0 |
| A1 | TI (LVMS) | FWY | 47.1 | 16.1 | 21.8 | 14.7 | 26.3 | 25.2 |
| B27 | RHK | FYL (WMI) | 28.4 | 26.1 | 13.3 | 13.9 | 35.3 | 23.4 |
| B62 | QL (IVMP) | FWY (MIV) | 12.6 | 4.8 | 36.5 | 25.4 | 11.1 | 18.1 |
| B58 | ATS | FWY (LIV) | 10.0 | 25.1 | 1.6 | 9.0 | 5.9 | 10.3 |

TABLE IV (G)

Calculated population coverage afforded by different HLA-supertype combinations

| | Phenotypic frequency | | | | | |
|---|---|---|---|---|---|---|
| HLA-supertypes | Caucasian | N.A Blacks | Japanese | Chinese | Hispanic | Average |
| A2, A3 and B7 | 83.0 | 86.1 | 87.5 | 88.4 | 86.3 | 86.2 |
| A2, A3, B7, A24, B44 and A1 | 99.5 | 98.1 | 100.0 | 99.5 | 99.4 | 99.3 |
| A2, A3, B7, A24 B44, A1, B27, B62, and B 58 | 99.9 | 99.6 | 100.0 | 99.8 | 99.9 | 99.8 |

Motifs indicate the residues defining supertype specificites. The motifs incorporate residues determined on the basis of published data to be recognized by multiple alleles within the supertype. Residues within brackets are additional residues also predicted to be tolerated by multiple alleles within the supertype.

TABLE V

Frequently Occurring Motifs

| Name | avrg. % identity | Description | Potential Function |
|---|---|---|---|
| zf-C2H2 | 34% | Zinc finger, C2H2 type | Nucleic acid-binding protein functions as transcription factor, nuclear location probable |
| cytochrome_b_N | 68% | Cytochrome b(N-terminal)/b6/petB | membrane bound oxidase, generate superoxide |
| lg | 19% | Immunoglobulin domain | domains are one hundred amino acids long and include a conserved intradomain disulfide bond. |
| WD40 | 18% | WD domain, G-beta repeat | tandem repeats of about 40 residues, each containing a Trp-Asp motif. Function in signal transduction and protein interaction |
| PDZ | 23% | PDZ domain | may function in targeting signaling molecules to sub-membranous sites |
| LRR | 28% | Leucine Rich Repeat | short sequence motifs involved in protein-protein interactions |
| Pkinase | 23% | Protein kinase domain | conserved catalytic core common to both serine/threonine and tyrosine protein kinases containing an ATP binding site and a catalytic site |
| PH | 16% | PH domain | pleckstrin homology involved in intracellular signaling or as constituents of the cytoskeleton |
| EGF | 34% | EGF-like domain | 30–40 amino-acid long found in the extracellular domain of membrane-bound proteins or in secreted proteins |
| Rvt | 49% | Reverse transcriptase (RNA-dependent DNA polymerase) | |
| Ank | 25% | Ank repeat | Cytoplasmic protein, associates integral membrane proteins to the cytoskeleton |

TABLE V-continued

| Frequently Occurring Motifs | | | |
|---|---|---|---|
| Name | avrg. % identity | Description | Potential Function |
| Oxidored_q1 | 32% | NADH-Ubiquinone/plastoquinone (complex I), various chains | membrane associated. Involved in proton translocation across the membrane |
| Efhand | 24% | EF hand | calcium-binding domain, consists of a12 residue loop flanked on both sides by a 12 residue alpha-helical domain |
| Rvp | 79% | Retroviral aspartyl protease | Aspartyl or acid proteases, centered on a catalytic aspartyl residue |
| Collagen | 42% | Collagen triple helix repeat (20 copies) | extracellular structural proteins involved in formation of connective tissue. The sequence consists of the G-X-Y and the polypeptide chains forms a triple helix. |
| Fn3 | 20% | Fibronectin type III domain | Located in the extracellular ligand-binding region of receptors and is about 200 amino acid residues long with two pairs of cysteines involved in disulfide bonds |
| 7tm_1 | 19% | 7 transmembrane receptor (rhodopsin family) | seven hydrophobic transmembrane regions, with the N-terminus located extracellularly while the C-terminus is cytoplasmic. Signal through G proteins |

TABLE VI

| Motifs and Post-translational Modifications of 282P1G3 | | |
|---|---|---|
| N-glycosylation site | | |
| 87–90 | NNSG | (SEQ ID NO: 54) |
| 231–234 | NDSS | (SEQ ID NO: 55) |
| 315–318 | NVSY | (SEQ ID NO: 56) |
| 410–413 | NHTA | (SEQ ID NO: 57) |
| 492–495 | NGTL | (SEQ ID NO: 58) |
| 498–501 | NRTT | (SEQ ID NO: 59) |
| 529–532 | NATK | (SEQ ID NO: 60) |
| 578–581 | NGTE | (SEQ ID NO: 61) |
| 591–594 | NLTI | (SEQ ID NO: 62) |
| 596–599 | NVTL | (SEQ ID NO: 63) |
| 641–644 | NRSV | (SEQ ID NO: 64) |
| 657–660 | NISE | (SEQ ID NO: 65) |
| 783–786 | NHTL | (SEQ ID NO: 66) |
| 838–841 | NSTL | (SEQ ID NO: 67) |
| 961–964 | NLTG | (SEQ ID NO: 68) |
| 973–976 | NDTY | (SEQ ID NO: 69) |
| 985–988 | NITT | (SEQ ID NO: 70) |
| 1000–1003 | NATT | (SEQ ID NO: 71) |
| 1042–1045 | NLTQ | (SEQ ID NO: 72) |
| 1071–1074 | NDSI | (SEQ ID NO: 73) |
| 1213–1216 | NGSS | (SEQ ID NO: 74) |
| Tyrosine sulfation site | | |
| 817–831 | TLYSGEDYPDTAPVI | (SEQ ID NO: 75) |
| 1083–1097 | GREYAGLYDDISTQG | (SEQ ID NO: 76) |
| 1145–1159 | KDETFGEYSDSDEKP | (SEQ ID NO: 77) |
| 1176–1190 | SADSLVEYGEGDHGL | (SEQ ID NO: 78) |
| cAMP-and cGMP-dependent protein kinase phosphorylation site | | |
| 684–687 | KKTT | (SEQ ID NO: 79) |
| Pkinase C phosphorylation site | | |
| 91–93 | TFR | |
| 112–114 | SNK | |
| 183–185 | SQK | |
| 226–228 | SLK | |
| 245–247 | SIK | |
| 310–312 | TLK | |
| 350–352 | TKK | |
| 377–379 | TIK | |
| 536–538 | SPK | |
| 563–565 | SLK | |

TABLE VI-continued

| Motifs and Post-translational Modifications of 282P1G3 | | |
|---|---|---|
| 637–639 | SER | |
| 643–645 | SVR | |
| 766–768 | TWK | |
| 785–787 | TLR | |
| 1002–1004 | TTK | |
| 1044–1046 | TQK | |
| 1128–1130 | SVK | |
| 1143–1145 | SVK | |
| 1163–1165 | SLR | |
| Casein kinase II phosphorylation site | | |
| 198–201 | SRND | (SEQ ID NO: 80) |
| 235–238 | SSTE | (SEQ ID NO: 81) |
| 260–263 | SGSE | (SEQ ID NO: 82) |
| 317–320 | SYQD | (SEQ ID NO: 83) |
| 385–388 | SPVD | (SEQ ID NO: 84) |
| 500–503 | TTEE | (SEQ ID NO: 85) |
| 501–504 | TEED | (SEQ ID NO: 86) |
| 554–557 | SKCD | (SEQ ID NO: 87) |
| 598–601 | TLED | (SEQ ID NO: 88) |
| 611–614 | TALD | (SEQ ID NO: 89) |
| 615–618 | SAAD | (SEQ ID NO: 90) |
| 623–626 | TVLD | (SEQ ID NO: 91) |
| 809–812 | SGPD | (SEQ ID NO: 92) |
| 820–823 | SGED | (SEQ ID NO: 93) |
| 870–873 | SLLD | (SEQ ID NO: 94) |
| 1027–1030 | TLGE | (SEQ ID NO: 95) |
| 1128–1131 | SVKE | (SEQ ID NO: 96) |
| 1143–1146 | SVKD | (SEQ ID NO: 97) |
| 1148–1151 | TFGE | (SEQ ID NO: 98) |
| 1153–1156 | SDSD | (SEQ ID NO: 99) |
| 1179–1182 | SLVE | (SEQ ID NO: 100) |
| Tyrosine kinase phosphorylation site | | |
| 480–487 | KPLEGRRY | (SEQ ID NO: 101) |
| N-myristoylation site | | |
| 116–121 | GIAMSE | (SEQ ID NO: 102) |
| 240–245 | GSKANS | (SEQ ID NO: 103) |
| 261–266 | GSESSI | (SEQ ID NO: 104) |
| 322–327 | GNYRCT | (SEQ ID NO: 105) |
| 364–369 | GILLCE | (SEQ ID NO: 106) |
| 424–429 | GTILAN | (SEQ ID NO: 107) |
| 506–511 | GSYSCW | (SEQ ID NO: 108) |

TABLE VI-continued

| Motifs and Post-translational Modifications of 282P1G3 | | |
|---|---|---|
| 579–584 | GTEDGR | (SEQ ID NO: 109) |
| 589–594 | GANLTI | (SEQ ID NO: 110) |
| 603–608 | GIYCCS | (SEQ ID NO: 111) |
| 651–656 | GADHNS | (SEQ ID NO: 112) |
| 888–893 | GQRNSG | (SEQ ID NO: 113) |
| 893–898 | GMVPSL | (SEQ ID NO: 114) |
| 960–965 | GNLTGY | (SEQ ID NO: 115) |
| 1040–1045 | GVNLTQ | (SEQ ID NO: 116) |
| 1101–1106 | GLMCAI | (SEQ ID NO: 117) |
| 1124–1129 | GGKYSV | (SEQ ID NO: 118) |
| 1162–1167 | GSLRSL | (SEQ ID NO: 119) |
| 1195–1200 | GSFIGA | (SEQ ID NO: 120) |
| 1199–1204 | GAYAGS | (SEQ ID NO: 121) |
| 1208–1213 | GSVESN | (SEQ ID NO: 122) |
| 1214–1219 | GSSTAT | (SEQ ID NO: 123) |
| | Amidation site | |
| 483–486 | EGRR | (SEQ ID NO: 124) |
| 682–685 | QGKK | (SEQ ID NO: 125) |

TABLE VII

Search Peptides v.1 ORE:272:3946

9-mers, 10-mers and 15-mers

```
MEPLLLGRGL IVYLMFLLLK FSKAIEIPSS VQQVPTIIKQ SKVQVAFPFD EYFQIECEAK  60      (SEQ ID NO:126)

GNPEPTFSWT KDGNPFYFTD HRIIPSNNSG TFRIPNEGHI SHFQGKYRCF ASNKLGIAMS  120

EEIEFIVPSV PKLPKEKIDP LEVEEGDPIV LPCNPPKGLP PLHIYWMNIE LEHIEQDERV  180

YMSQKODLYF ANVEEKDSRN DYCCFAAFPR LRTIVQKMPM KLTVNSLKHA NDSSSSTEIG  240

SKANSIKQRK PKLLLPPTES GSESSITILK GEILLLECFA EGLPTPQVDW NKIGGDLPKG  300

RETKENYGKT LKIENVSYQD KGNYRCTASN FLGTATEDEN VIVEEPPRWT KKPQSAVYST  360

GSNGILLGFA EGEPQPTIKW RVNGSPVDNH PFAGDVVFPR EISFTNLQPN HTAVYQCEAS  420

NVHGTILANA NIDVVDVRPL IQTKDGENYA TVVGYSAFLH CEFFASPEAV VSWQKVEEVK  480

PLEGRRYHIY ENGTLQINRT TEEOAOSYSC WVENAIGKTA VTANLDIRNA TKLRVSPKNP  540

RIPKLHMLEL HCESKCDSHL KHSLKLSWSK GGEAFEINGT EDGRITIDGA NLTISNVTLE  600

DQGIYCCSAH TALDSAADIT QVTVLDVPDP PENLHLSERQ NRSVRLTWEA GADHNSNISE  660

YIVEFEGNKE EPGRWEELTR VQGKKTTVIL PLAPFVRYQF RVIAVNEVGR SQPSQPSOHH  720

ETPPAAPDRN PQNIRVQASQ PKEMIIKWEP LKSMEQNGPG LEYRVTWKPQ GAPVEWEEET  780

VTNHTLRVMT PAVYAPYDVK VQAINQLGSG PDPQSVTLYS GEDYPOTAPT IHGVDVINST  840

LVKVTWSTVP KDRVHGRLKG YQINWWKTKS LLDGRTHPKE VNILRFSGQR NSGMVPSLDA  900

FSEFHLTVLA YNSKGAGPES EPYIFQTPEG VPEQPTFLKV IKVDKDTATL SWGLPKKLNG  960

NLTGYLLQYQ IINDTYEIGE LNDINITTPS KPSWHLSNLN ATTKYKFYLR ACTSQGCGKP  1020

ITEESSTLGE GSKGICKISG VNLTQKTHPI EVFEPGAEHI VRLMTKNWGD NDSIFQDVIE  1080

TRGREYAGLY DDISTQGWFI GLMCAIALLT LLLLTVCFVK RNRGGKYSVK EKEDLHPDPE  1140

IQSVKDETFG EYSDSDEKPL KGSLRSLNRD MQPTESADSL VEYGEGDHGL FSEDGSFIGA  1200

YAGSKEKGSV ESNGSSTATF PLRA 1224
```

v.2 ORF:272-3787

9-mers

| | | |
|---|---|---|
| aa 125–141 | FIVPSVPKFPKEKTDPL | (SEQ ID NO:127) |
| aa 295–311 | GDLPKGREAKENYGKTL | (SEQ ID NO:128) |
| aa 1024–1040 | ESSTLGEGKYAGLYDDI | (SEQ ID NO:129) |

TABLE VII-continued

| Search Peptides | | |
|---|---|---|
| 10-mers | | |
| aa 124–142 | EFIVPSVPKFPKEKIDPLE | (SEQ ID NO:130) |
| aa 294–312 | GGDLPKGREAKENYGKTLK | (SEQ ID NO:131) |
| aa 1023–1041 | EESSTLGEGKYAGLYDDIS | (SEQ ID NO:132) |
| 15-mers | | |
| aa 119–147 | MSEEIEFIVPSVPKFPKEKIDPLEVEEGD | (SEQ ID NO:133) |
| aa 289–317 | DWNKIGGDLPKGREAKENYGKTLKIENVS | (SEQ ID NO:134) |
| aa 1018–1046 | GKPITEESSTLGEGKYAGLYDDISTQGWF | (SEQ ID NO:135) |
| v.3 ORF:272..2953 Frame +2 | | |
| 9-mers | | |
| aa 830–848 | VIHGVGVINTTYVSN TTYVSNATGSPQ PSIFICSKEQ ELSYRNRNML AEDFIQKSTS CNYVEKSSTF FKI | (SEQ ID NO:136) |
| 10-mers | | |
| aa 829–849 | PVIHGVDVINTTYVSN TTYVSNATGSPQ PSIFICSKEQ ELSYRNRNML AEDFIQKSTS CNYVEKSSTF FKI | (SEQ ID NO:137) |
| 15-mers | | |
| aa 824–854 | YPDTAPVIHGVDVINTTYVSN TTYVSNATGSPQ PSIFICSKEQ ELSYRNRNML AEDFIQKSTS CNYVEKSSTF FKI | (SEQ ID NO:138) |
| v.4 ORF:272..3625 Frame +2 | | |
| 9-mers | | |
| aa 816–832 | VTLYSGEDLPEQPTFLK | (SEQ ID NO:139) |
| 10-mers | | |
| aa 815–833 | SVTLYSGEDLPEQPTFLKV | (SEQ ID NO:140) |
| 15-mers | | |
| aa 810–838 | OPDPQSVTLYSGEDLPEQPTFLKVIKVDK | (SEQ ID NO:141) |
| v.5 ORF: 272..3898 Frame +2 | | |
| 9-mers | | |
| aa 219–235 | PMKLTVNSSNSIKQRKP | (SEQ ID NO:142) |
| 10-mers | | |
| aa 218–236 | MPMKLTVNSSNSIKQRKPK | (SEQ ID NO:143) |
| 15-mers | | |
| aa 213–241 | TIVQKMPMKLTVNSSNSIKQPRKPKLLLPP | (SEQ ID NO:144) |
| v.6 ORF: 272..3823 Frame +2 | | |
| 9-mers | | |
| aa 121–137 | EEIEFIVPKLEHIEQDE | (SEQ ID NO:145) |
| 10-mers | | |
| aa 122–139 | SEEIEFIVPKLEHIEQDER | (SEQ ID NO:146) |
| 15-mers | | |
| aa 115–143 | LGIAMSEEIEFIVPKLEHTEQDERVYMSQ | (SEQ ID NO:147) |
| v.7 ORF:272..3982 Frame +2 | | |
| 9-mers | | |
| aa 337–364 | HDFHVIVEDNISHELFTLHPEPPRWTKK | (SEQ ID NO:148) |
| 10 mers | | |
| aa 336–365 | THDFIIVIVEDNISHELFTLHPEPPRWTKKP | (SEQ ID NO:149) |
| 15-mers | | |
| aa 331–370 | FLGTATHDFHVIVEDNISHELFTLHPEPPRWTKKPQSAVY | (SEQ ID NO:150) |

Tables VIII–XXI:

TABLE VIII

| Start | Subsequence | Score |
|---|---|---|
| | V1-HLA-A1-9mers-282P1G3 Each peptide is a portion of SEQ ID NO: 3; each start position is specified, the length of peptide is 9 amino acids, and the end position for each peptide is the start position plus eight, | |
| 500 | TTEEDAGSY | 112.500 |
| 919 | ESEPYIFQT | 67.500 |
| 173 | HIEQDERVY | 45.000 |
| 1078 | VIETRGREY | 45.000 |
| 371 | EGEPQPTIK | 45.000 |
| 931 | VPEQPTFLK | 22.500 |
| 524 | NLDIRNATK | 20.000 |
| 760 | GLEYRVTWK | 18.000 |
| 547 | MLELHCESK | 18.000 |
| 579 | GTEDGRIII | 11.250 |
| 871 | LLDGRTHPK | 10.000 |
| 343 | VEEPPRWTK | 9.000 |
| 1191 | FSEDGSFIG | 6.750 |
| 119 | MSEEIEFIV | 6.750 |
| 78 | FTDHRIIPS | 6.250 |
| 145 | EGDPIVLPC | 6.250 |
| 721 | ETPPAAPDR | 5.000 |
| 915 | GAGPESEPY | 5.000 |
| 396 | VVFPREISF | 5.000 |
| 168 | NIELEHIEQ | 4.500 |
| 598 | TLEDQGIYC | 4.500 |
| 917 | GPESEPYIF | 4.500 |
| 149 | IVLPCNPPK | 4.000 |
| 1154 | DSDEKPLKG | 3.750 |
| 434 | VVDVRPLIQ | 2.500 |
| 948 | ATLSWGLPK | 2.500 |
| 961 | NLTGYLLQY | 2.500 |
| 287 | QVDWNKIGG | 2.500 |
| 789 | MTPAVYAPY | 2.500 |
| 586 | IIDGANLTI | 2.500 |
| 810 | GPDPQSVTL | 2.500 |
| 236 | STEIGSKAN | 2.250 |
| 1021 | ITEESSTLG | 2.250 |
| 1183 | YGEGDHGLF | 2.250 |
| 62 | NPEPTFSWT | 2.250 |
| 416 | QCEASNVHG | 1.800 |
| 142 | EVEEGDPIV | 1.800 |
| 122 | EIEFIVPSV | 1.800 |
| 1175 | ESADSLVEY | 1.500 |
| 261 | GSESSITIL | 1.350 |
| 901 | FSEFHLTVL | 1.350 |
| 627 | VPDPPENLH | 1.250 |
| 1144 | VKDETFGEY | 1.250 |
| 1136 | HPDPEIQSV | 1.250 |
| 816 | VTLYSGEDY | 1.250 |
| 70 | TKDGNPFYF | 1.250 |
| 597 | VTLEDQGIY | 1.250 |
| 157 | KGLPPLHIY | 1.250 |
| 571 | DGEAFEING | 1.125 |
| 270 | KGEILLLEC | 1.125 |
| 978 | IGELNDINI | 1.125 |
| 1112 | LLLTVCFVK | 1.000 |
| 137 | KIDPLEVEE | 1.000 |
| 616 | AADITQVTV | 1.000 |
| 45 | VAFPFDEYF | 1.000 |
| 835 | DVINSTLVK | 1.000 |
| 279 | FAEGLPTPQ | 0.900 |
| 369 | EAEGEPQPT | 0.900 |
| 54 | QIECEAKGN | 0.900 |
| 342 | IVEEPPRWT | 0.900 |
| 192 | NVEEKDSRN | 0.900 |
| 753 | SMEQNGPGL | 0.900 |
| 511 | WVENAIGKT | 0.900 |
| 1056 | GAEHIVRLM | 0.900 |
| 551 | HCESKCDSH | 0.900 |

TABLE VIII-continued

| Start | Subsequence | Score |
|---|---|---|
| 367 | LCEAEGEPQ | 0.900 |
| 1180 | LVEYGEGDH | 0.900 |
| 275 | LLECFAEGL | 0.900 |
| 24 | AIEIPSSVQ | 0.900 |
| 1209 | SVESNGSST | 0.900 |
| 738 | ASQPKEMII | 0.750 |
| 316 | VSYQDKGNY | 0.750 |
| 1152 | YSDSDEKPL | 0.750 |
| 199 | RNDYCCFAA | 0.625 |
| 1068 | WGDNDSIFQ | 0.625 |
| 44 | QVAFPFDEY | 0.500 |
| 99 | HISHFQGKY | 0.500 |
| 1000 | NATTKYKFY | 0.500 |
| 158 | GLPPLHIYW | 0.500 |
| 117 | IAMSEEIEF | 0.500 |
| 392 | FAGDVVFPR | 0.500 |
| 1176 | SADSLVEYG | 0.500 |
| 612 | ALDSAADIT | 0.500 |
| 651 | GADHNSNIS | 0.500 |
| 875 | RTHPKEVNI | 0.500 |
| 833 | GVDVINSTL | 0.500 |
| 202 | YCCFAAFPR | 0.500 |
| 897 | SLDAFSEFH | 0.500 |
| 906 | LTVLAYNSK | 0.500 |
| 986 | ITTPSKPSW | 0.500 |
| 555 | KCDSHLKHS | 0.500 |
| 893 | GMVPSLDAF | 0.500 |
| 957 | KLNGNLTGY | 0.500 |
| 689 | ILPLAPFVR | 0.500 |
| 853 | RVHGRLKGY | 0.500 |
| 13 | YLMFLLLKF | 0.500 |
| 929 | EGVPEQPTF | 0.500 |
| 1052 | VFEPGAEHI | 0.450 |
| 213 | TIVQKMPMK | 0.400 |
| 949 | TLSWGLPKK | 0.400 |
| | V2-HLA-A1-9mers-(SET 1)-282P1G3 Each peptide is a portion of SEQ ID NO: 5; each start position is specified, the length of peptide is 9 amino acids, and the end position for each peptide is the start position plus eight. | |
| 1 | FIVPSVPKF | 2.000 |
| 3 | VPSVPKFPK | 0.250 |
| 5 | SVPKFPKEK | 0.020 |
| 4 | PSVPKFPKE | 0.003 |
| 2 | IVPSVPKFP | 0.001 |
| 6 | VPKFPKEKI | 0.000 |
| 9 | FPKEKIDPL | 0.000 |
| 7 | PKFPKEKID | 0.000 |
| 8 | KFPKEKIDP | 0.000 |
| | V2-HLA-A1-9mers-(SET 2)-282P1G3 Each peptide is a portion of SEQ ID NO: 5; each start position is specified, the length of peptide is 9 amino acids, and the end position for each peptide is the start position plus eight. | |
| 9 | AKENYGKTL | 0.045 |
| 6 | GREAKENYG | 0.045 |
| 2 | DLPKGREAK | 0.020 |
| 5 | KGREAKENY | 0.013 |
| 1 | GDLPKGREA | 0.005 |
| 7 | REAKENYGK | 0.002 |
| 8 | EAKENYGKT | 0.001 |
| 3 | LPKGREAKE | 0.000 |
| 4 | PKGREAKEN | 0.000 |
| | V2-HLA-A1-9mers-(SET 3)-282P1G3 Each peptide is a portion of SEQ ID NO: 5; each start | |

TABLE VIII-continued

| Start | Subsequence | Score |
|---|---|---|
| | position is specified, the length of peptide is 9 amino acids, and the end position for each peptide is the start position plus eight. | |
| 2 | SSTLGEGKY | 0.750 |
| 5 | LGEGKYAGL | 0.450 |
| 1 | ESSTLGEGK | 0.300 |
| 3 | STLGEGKYA | 0.025 |
| 4 | TLGEGKYAG | 0.020 |
| 6 | GEGKYAGLY | 0.003 |
| 9 | KYAGLYDDI | 0.001 |
| 7 | EGKYAGLYD | 0.000 |
| 8 | GKYAGLYDD | 0.000 |
| | V3-HLA-A1-9mers-282P1G3 Each peptide is a portion of SEQ ID NO: 7; each start position is specified, the length of peptide is 9 amino acids, and the end position for each peptide is the start position plus eight. | |
| 4 | GVDVINTTY | 25.000 |
| 36 | EQELSYRNR | 1.350 |
| 10 | TTYVSNTTY | 1.250 |
| 55 | STSCNYVEK | 1.000 |
| 46 | MLAEDFIQK | 1.000 |
| 47 | LAEDFIQKS | 0.900 |
| 60 | YVEKSSTFF | 0.900 |
| 34 | SKEQELSYR | 0.450 |
| 33 | CSKEQELSY | 0.375 |
| 23 | TGSPQPSIF | 0.250 |
| 25 | SPQPSIFIC | 0.125 |
| 24 | GSPQPSIFI | 0.075 |
| 22 | ATGSPQPSI | 0.050 |
| 27 | QPSIFICSK | 0.050 |
| 16 | TTYVSNATG | 0.050 |
| 13 | VSNTTYVSN | 0.030 |
| 15 | NTTYVSNAT | 0.025 |
| 48 | AEDFIQKST | 0.025 |
| 45 | NMLAEDFIQ | 0.025 |
| 9 | NTTYVSNTT | 0.025 |
| 1 | VIHGVDVIN | 0.020 |
| 7 | VINTTYVSN | 0.020 |
| 12 | YVSNTTYVS | 0.020 |
| 6 | DVINTTYVS | 0.020 |
| 19 | VSNATGSPQ | 0.015 |
| 56 | TSCNYVEKS | 0.015 |
| 29 | SIFICSKEQ | 0.010 |
| 21 | NATGSPQPS | 0.010 |
| 57 | SCNYVEKSS | 0.010 |
| 38 | ELSYRNRNM | 0.010 |
| 31 | FICSKEQEL | 0.010 |
| 52 | IQKSTSCNY | 0.007 |
| 61 | VEKSSTFFK | 0.005 |
| 59 | NYVEKSSTF | 0.005 |
| 43 | NRNMLAEDF | 0.005 |
| 54 | KSTSCNYVE | 0.003 |
| 3 | HGVDVINTT | 0.003 |
| 44 | RNMLAEDFI | 0.003 |
| 8 | INTTYVSNT | 0.003 |
| 58 | CNYVEKSST | 0.003 |
| 14 | SNTTYVSNA | 0.003 |
| 62 | EKSSTFFKI | 0.003 |
| 2 | IHGVDVINT | 0.003 |
| 39 | LSYRNRNML | 0.002 |

TABLE VIII

| Start | Subsequence | Score |
|---|---|---|
| | V3-HLA-A1-9mers-282P1G3 Each peptide is a portion of SEQ ID NO: 7; each start position is specified, the length of peptide is 9 amino acids, and the end position for each peptide is the start position plus eight. | |
| 51 | FIQKSTSCN | 0.001 |
| 18 | YVSNATGSP | 0.001 |
| 32 | ICSKEQELS | 0.001 |
| 35 | KEQELSYRN | 0.001 |
| 26 | PQPSIFICS | 0.001 |
| 37 | QELSYRNRN | 0.001 |
| 20 | SNATGSPQP | 0.001 |
| 5 | VDVINTTYV | 0.001 |
| 49 | EDFIQKSTS | 0.001 |
| 11 | TYVSNTTYV | 0.001 |
| 50 | DFIQKSTSC | 0.001 |
| 53 | QKSTSCNYV | 0.001 |
| 17 | TYVSNATGS | 0.001 |
| 40 | SYRNRNMLA | 0.000 |
| 28 | PSIFICSKE | 0.000 |
| 42 | RNRNMLAED | 0.000 |
| 30 | IFICSKEQE | 0.000 |
| 41 | YRNRNMLAE | 0.000 |
| | V4-HLA-A1-9mers-282P1G3 Each peptide is a portion of SEQ ID NO: 9; each start position is specified, the length of peptide is 9 amino acids, and the end position for each peptide is the start position plus eight. | |
| 9 | LPEQPTFLK | 22.500 |
| 7 | EDLPEQPTF | 0.100 |
| 4 | YSGEDLPEQ | 0.030 |
| 6 | GEDLPEQPT | 0.025 |
| 1 | VTLYSGEDL | 0.025 |
| 5 | SGEDLPEQP | 0.022 |
| 8 | DLPEQPTFL | 0.010 |
| 2 | TLYSGEDLP | 0.001 |
| 3 | LYSGEDLPE | 0.000 |
| | V5-HLA-A1-9mers-282P1G3 Each peptide is a portion of SEQ ID NO: 11; each start position is specified, the length of peptide is 9 amino acids, and the end position for each peptide is the start position plus eight. | |
| 8 | SSNSIKQRK | 0.300 |
| 5 | TVNSSNSIK | 0.200 |
| 7 | NSSNSIKQR | 0.150 |
| 4 | LTVNSSNSI | 0.025 |
| 6 | VNSSNSIKQ | 0.013 |
| 3 | KLTVNSSNS | 0.010 |
| 2 | MKLTVNSSN | 0.001 |
| 9 | SNSIKQRKP | 0.000 |
| 1 | PMKLTVNSS | 0.000 |
| | V6-HLA-A1-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 1.800 |

TABLE VIII-continued

| Start | Subsequence | Score |
|---|---|---|
| 5 | FIVPKLEHI | 0.100 |
| 9 | KLEHIEQDE | 0.090 |
| 1 | EEIEFIVPK | 0.020 |
| 4 | EFIVPKLEH | 0.003 |
| 7 | VPKLEHIEQ | 0.001 |
| 6 | IVPKLEHIE | 0.000 |
| 3 | IEFIVPKLE | 0.000 |
| 8 | PKLEHIEQD | 0.000 |
| | V7-HLA-A1-9mers-282P1G3 Each peptide is a portion of SEQ ID NO: 15; each start position is specified, the length of peptide is 9 amino acids, and the end position for each peptide is the start position plus eight. | |
| 19 | HPEPPRWTK | 45.000 |
| 16 | FTLHPEPPR | 0.500 |
| 17 | TLHPEPPRW | 0.200 |
| 6 | IVEDNISHE | 0.090 |
| 5 | VIVEDNISH | 0.050 |
| 10 | NISHELFTL | 0.050 |
| 7 | VEDNISHEL | 0.025 |
| 12 | SHELFTLHP | 0.022 |
| 11 | ISHELFTLH | 0.015 |
| 9 | DNISHELFT | 0.013 |
| 20 | PEPPRWTKK | 0.010 |
| 4 | HVIVEDNIS | 0.010 |
| 8 | EDNISHELF | 0.005 |
| 14 | ELFTLHPEP | 0.002 |
| 2 | DFHVIVEDN | 0.001 |
| 18 | LHPEPPRWT | 0.001 |
| 3 | FHVIVEDNI | 0.001 |
| 1 | HDFHVIVED | 0.000 |
| 15 | LFTLHPEPP | 0.000 |
| 13 | HELFTLHPE | 0.000 |

TABLE IX

| Start | Subsequence | Score |
|---|---|---|
| | V1-HLA-A1-10mers-282P1G3 Each peptide is a portion of SEQ ID NO: 3; each start position is specified, the length of peptide is 10 amino acids, and the end position for each peptide is the start position plus nine. | |
| 261 | GSESSITILK | 135.000 |
| 810 | GPDPQSVTLY | 62.500 |
| 62 | NPEPTFSWTK | 45.000 |
| 1152 | YSDSDEKPLK | 30.000 |
| 1136 | HPDPEIQSVK | 25.000 |
| 1028 | LGEGSKGIGK | 22.500 |
| 312 | KIENVSYQDK | 18.000 |
| 342 | IVEEPPRWTK | 18.000 |
| 738 | ASQPKEMIIK | 15.000 |
| 371 | EGEPQPTIKW | 11.250 |
| 406 | NLQPNHTAVY | 10.000 |
| 343 | VEEPPRWTKK | 9.000 |
| 170 | ELEHIEQDER | 9.000 |
| 658 | ISEYIVEFEG | 6.750 |
| 1191 | FSEDGSFIGA | 6.750 |
| 627 | VPDPPENLHL | 6.250 |
| 788 | VMTPAVYAPY | 5.000 |
| 688 | VILPLAPFVR | 5.000 |
| 137 | KIDPLEVEEG | 5.000 |
| 1056 | GAEHIVRLMT | 4.500 |
| 481 | PLEGRYHIY | 4.500 |

TABLE IX-continued

| Start | Subsequence | Score |
|---|---|---|
| 236 | STEIGSKANS | 4.500 |
| 1149 | FGEYSDSDEK | 4.500 |
| 466 | SPEAVVSWQ | 4.500 |
| 475 | KVEEVKPLEG | 4.500 |
| 142 | EVEEGDPIVL | 4.500 |
| 901 | FSEFHLTVLA | 2.700 |
| 434 | VVDVRPLIQT | 2.500 |
| 897 | SLDAFSEFHL | 2.500 |
| 78 | FTDHRIIPSN | 2.500 |
| 145 | EGDPIVLPCN | 2.500 |
| 4 | LLLGRGLIVY | 2.500 |
| 199 | RNDYCCFAAF | 2.500 |
| 612 | ALDSAADITQ | 2.500 |
| 500 | TTEEDAGSYS | 2.250 |
| 747 | KWEPLKSMEQ | 2.250 |
| 270 | KGEILLLECF | 2.250 |
| 369 | EAEGEPQPTI | 1.800 |
| 279 | FAEGLPTPQV | 1.800 |
| 460 | HCEFFASPEA | 1.800 |
| 173 | HIEQDERVYM | 1.800 |
| 24 | AIEIPSSVQQ | 1.800 |
| 300 | GRETKENYGK | 1.800 |
| 598 | TLEDQGIYCC | 1.800 |
| 919 | ESEPYIFQTP | 1.350 |
| 636 | LSERQNRSVR | 1.350 |
| 1192 | SEDGSFIGAY | 1.250 |
| 499 | RTTEEDAGSY | 1.250 |
| 917 | GPESEPYIFQ | 1.125 |
| 1021 | ITEESSTLGE | 1.125 |
| 1183 | YGEGDHGLFS | 1.125 |
| 579 | GTEDGRIIID | 1.125 |
| 931 | VPEQPTFLKV | 1.125 |
| 930 | GVPEQPTFLK | 1.000 |
| 948 | ATLSWGLPKK | 1.000 |
| 1111 | LLLLTVCFVK | 1.000 |
| 212 | RTIVQKMPMK | 1.000 |
| 11 | IVYLMFLLLK | 1.000 |
| 126 | IVPSVPKLPK | 1.000 |
| 689 | ILPLAPFVRY | 1.000 |
| 30 | SVQQVPTIIK | 1.000 |
| 624 | VLDVPDPPEN | 1.000 |
| 947 | TATLSWGLPK | 1.000 |
| 1078 | VIETRGREYA | 0.900 |
| 511 | WVENAIGKTA | 0.900 |
| 1180 | LVEYGEGDHG | 0.900 |
| 416 | QCEASNVHGT | 0.900 |
| 547 | MLELHCESKC | 0.900 |
| 551 | HCESKCDSHL | 0.900 |
| 303 | TKENYGKTLK | 0.900 |
| 675 | WEELTRVQGK | 0.900 |
| 1209 | SVESNGSSTA | 0.900 |
| 996 | LSNLNATTKY | 0.750 |
| 1154 | DSDEKPLKGS | 0.750 |
| 1075 | FQDVIETRGR | 0.750 |
| 119 | MSEEIEFIVP | 0.675 |
| 824 | YPDTAPVIHG | 0.625 |
| 960 | GNLTGYLLQY | 0.625 |
| 431 | NIDVVDVRPL | 0.500 |
| 616 | AADITQVTVL | 0.500 |
| 586 | IIDGANLTIS | 0.500 |
| 847 | STVPKDRVHG | 0.500 |
| 395 | DVVFPREISF | 0.500 |
| 524 | NLDIRNATKL | 0.500 |
| 555 | KCDSHLKHSL | 0.500 |
| 833 | GVDVINSTLV | 0.500 |
| 686 | TTVILPLAPF | 0.500 |
| 596 | NVTLEDQGIY | 0.500 |
| 14 | LMFLLLKFSK | 0.500 |
| 315 | NVSYQDKGNY | 0.500 |
| 815 | SVTLYSGEDY | 0.500 |
| 478 | EVKPLEGRRY | 0.500 |
| 440 | LIQTKDGENY | 0.500 |
| 283 | LPTPQVDWNK | 0.500 |
| 116 | GIAMSEEIEF | 0.500 |
| 1077 | DVIETRGREY | 0.500 |
| 1109 | LTLLLLTVCF | 0.500 |
| 1134 | DLHPDPEIQS | 0.500 |

TABLE IX-continued

| Start | Subsequence | Score |
|---|---|---|
| 445 | DGENYATVVG | 0.450 |
| 669 | KEEPGRWEEL | 0.450 |
| | V2-HLA-A1-10mers-(SET 1)-282P1G3 Each peptide is a portion of SEQ ID NO: 5; each start position is specified, the length of peptide is 10 amino acids, and the end position for each peptide is the start position plus nine. | |
| 3 | IVPSVPKFPK | 1.000 |
| 5 | PSVPKFPKEK | 0.300 |
| 1 | EFIVPSVPKF | 0.010 |
| 2 | FIVPSVPKFP | 0.010 |
| 6 | SVPKFPKEKI | 0.001 |
| 4 | VPSVPKFPKE | 0.001 |
| 8 | PKFPKEKIDP | 0.000 |
| 10 | FPKEKIDPLE | 0.000 |
| 9 | KFPKEKIDPL | 0.000 |
| 7 | VPKFPKEKID | 0.000 |
| | V2-HLA-A1-10mers-(SET 2)-282P1G3 Each peptide is a portion of SEQ ID NO: 5; each start position is specified, the length of peptide is 10 amino acids, and the end position for each peptide is the start position plus nine. | |
| 5 | LGEGKYAGLY | 11.250 |
| 1 | ESSTLGEGKY | 0.750 |
| 3 | STLGEGKYAG | 0.050 |
| 4 | TLGEGKYAGL | 0.020 |
| 2 | SSTLGEGKYA | 0.015 |
| 8 | GKYAGLYDDI | 0.001 |
| 7 | EGKYAGLYDD | 0.000 |
| 6 | GEGKYAGLYD | 0.000 |
| | V2-HLA-A1-10mers-(SET 3)-282P1G3 Each peptide is a portion of SEQ ID NO: 5; each start position is specified, the length of peptide is 10 amino acids, and the end position for each peptide is the start position plus nine. | |
| 6 | LGEGKYAGLY | 11.250 |
| 2 | ESSTLGEGKY | 0.750 |
| 4 | STLGEGKYAG | 0.050 |
| 5 | TLGEGKYAGL | 0.020 |
| 3 | SSTLGEGKYA | 0.015 |
| 1 | EESSTLGEGK | 0.010 |
| 10 | KYAGLYDDIS | 0.001 |
| 9 | GKYAGLYDDI | 0.001 |
| 8 | EGKYAGLYDD | 0.000 |
| 7 | GEGKYAGLYD | 0.000 |
| | V3-HLA-A1-10mers-282P1G3 Each peptide is a portion of SEQ ID NO: 7; each start position is specified, the length of peptide is 10 amino acids, and the end position for each peptide is the start position plus nine. | |
| 61 | YVEKSSTFFK | 9.000 |
| 10 | NTTYVSNTTY | 1.250 |
| 48 | LAEDFIQKST | 0.900 |
| 55 | KSTSCNYVEK | 0.600 |
| 46 | NMLAEDFIQK | 0.500 |
| 5 | GVDVINTTYV | 0.500 |
| 33 | ICSKEQELSY | 0.250 |

TABLE IX-continued

| Start | Subsequence | Score |
|---|---|---|
| 23 | ATGSPQPSIF | 0.250 |
| 37 | EQELSYRNRN | 0.135 |
| 26 | SPQPSIFICS | 0.125 |
| 4 | HGVDVINTTY | 0.125 |
| 24 | TGSPQPSIFI | 0.125 |
| 35 | SKEQELSYRN | 0.090 |
| 25 | GSPQPSIFIC | 0.075 |
| 52 | FIQKSTSCNY | 0.050 |
| 16 | NTTYVSNATG | 0.050 |
| 2 | VIHGVDVINT | 0.050 |
| 49 | AEDFIQKSTS | 0.025 |
| 56 | STSCNYVEKS | 0.025 |
| 11 | TTYVSNTTYV | 0.025 |
| 17 | TTYVSNATGS | 0.025 |
| 59 | CNYVEKSSTF | 0.025 |
| 13 | YVSNTTYVSN | 0.020 |
| 22 | NATGSPQPSI | 0.020 |
| 7 | DVINTTYVSN | 0.020 |
| 34 | CSKEQELSYR | 0.015 |
| 14 | VSNTTYVSNA | 0.015 |
| 57 | TSCNYVEKSS | 0.015 |
| 45 | RNMLAEDFIQ | 0.013 |
| 47 | MLAEDFIQKS | 0.010 |
| 32 | FICSKEQELS | 0.010 |
| 58 | SCNYVEKSST | 0.010 |
| 8 | VINTTYVSNT | 0.010 |
| 19 | YVSNATGSPQ | 0.010 |
| 39 | ELSYRNRNML | 0.010 |
| 40 | LSYRNRNMLA | 0.008 |
| 60 | NYVEKSSTFF | 0.005 |
| 36 | KEQELSYRNR | 0.005 |
| 20 | VSNATGSPQP | 0.003 |
| 27 | PQPSIFICSK | 0.003 |
| 15 | SNTTYVSNAT | 0.003 |
| 43 | RNRNMLAEDF | 0.003 |
| 9 | INTTYVSNTT | 0.003 |
| 21 | SNATGSPQPS | 0.003 |
| 1 | PVIHGVDVIN | 0.002 |
| 29 | PSIFICSKEQ | 0.002 |
| 12 | TYVSNTTYVS | 0.001 |
| 30 | SIFICSKEQE | 0.001 |
| 6 | VDVINTTYVS | 0.001 |
| 31 | IFICSKEQEL | 0.001 |
| 38 | QELSYRNRNM | 0.001 |
| 3 | IHGVDVINTT | 0.001 |
| 51 | DFIQKSTSCN | 0.001 |
| 50 | EDFIQKSTSC | 0.001 |
| 44 | NRNMLAEDFI | 0.001 |
| 62 | VEKSSTFFKI | 0.000 |
| 28 | QPSIFICSKE | 0.000 |
| 53 | IQKSTSCNYV | 0.000 |
| 54 | QKSTSCNYVE | 0.000 |
| 18 | TYVSNATGSP | 0.000 |
| 41 | SYRNRNMLAE | 0.000 |
| 42 | YRNRNMLAED | 0.000 |
| | V4-HLA-A1-10mers-282P1G3 Each peptide is a portion of SEQ ID NO: 9; each start position is specified, the length of peptide is 10 amino acids, and the end position for each peptide is the start position plus nine. | |
| 10 | LPEQPTFLKV | 1.125 |
| 9 | DLPEQPTFLK | 1.000 |
| 7 | GEDLPEQPTF | 0.500 |
| 6 | SGEDLPEQPT | 0.225 |
| 1 | SVTLYSGEDL | 0.010 |
| 8 | EDLPEQPTFL | 0.005 |
| 3 | TLYSGEDLPE | 0.005 |
| 2 | VTLYSGEDLP | 0.003 |
| 5 | YSGEDLPEQP | 0.002 |
| 4 | LYSGEDLPEQ | 0.001 |
| | V5-HLA-A1-10mers-282P1G3 | |

TABLE IX-continued

| Start | Subsequence | Score |
|---|---|---|
| | Each peptide is a portion of SEQ ID NO: 11; each start position is specified, the length of peptide is 10 amino acids, and the end position for each peptide is the start position plus nine. | |
| 5 | LTVNSSNSIK | 0.500 |
| 8 | NSSNSIKQRK | 0.300 |
| 10 | SNSIKQRKPK | 0.050 |
| 6 | TVNSSNSIKQ | 0.050 |
| 7 | VNSSNSIKQR | 0.025 |
| 4 | KLTVNSSNSI | 0.010 |
| 9 | SSNSIKQRKP | 0.002 |
| 3 | MKLTVNSSNS | 0.001 |
| 1 | MPMKLTVNSS | 0.000 |
| 2 | PMKLTVNSSN | 0.000 |

TABLE XI

| Start | Subsequence | Score |
|---|---|---|
| | V6-HLA-A1-10mers-282P1G3 Each peptide is a portion of SEQ ID NO: 13; each start position is specified, the length of peptide is 10 amino acids, and the end position for each peptide is the start position plus nine. | |
| 10 | KLEHIEQDER | 9.000 |
| 1 | SEEIEFIVPK | 1.800 |
| 3 | EIEFIVPKLE | 0.090 |
| 6 | FIVPKLEHIE | 0.010 |
| 7 | IVPKLEHIEQ | 0.005 |
| 4 | IEFIVPKLEH | 0.003 |
| 2 | EEIEFIVPKL | 0.001 |
| 5 | EFIVPKLEHI | 0.001 |
| 8 | VPKLEHIEQD | 0.000 |
| 9 | PKLEHIEQDE | 0.000 |
| | V7-HLA-A1-10mers-282P1G3 Each peptide is a portion of SEQ ID NO: 15; each start position is specified, the length of peptide is 10 amino acids, and the end position for each peptide is the start position plus nine. | |
| 20 | HPEPPRWTKK | 45.000 |
| 7 | IVEDNISHEL | 0.900 |
| 8 | VEDNISHELF | 0.250 |
| 18 | TLHPEPPRWT | 0.100 |
| 5 | HVIVEDNISH | 0.050 |
| 17 | FTLHPEPPRW | 0.050 |
| 10 | DNISHELFTL | 0.013 |
| 19 | LHPEPPRWTK | 0.010 |
| 16 | LFTLHPEPPR | 0.010 |
| 11 | NISHELFTLH | 0.010 |
| 12 | ISHELFTLHP | 0.007 |
| 1 | THDFHVIVED | 0.005 |
| 13 | SHELFTLHPE | 0.005 |
| 9 | EDNISHELFT | 0.003 |
| 15 | ELFTLHPEPP | 0.001 |
| 6 | VIVEDNISHE | 0.001 |
| 2 | HDFHVIVEDN | 0.001 |
| 4 | FHVIVEDNIS | 0.001 |
| 3 | DFHVIVEDNI | 0.001 |
| 14 | HELFTLHPEP | 0.000 |
| 21 | PEPPRWTKKP | 0.000 |

TABLE XI-continued

| Start | Subsequence | Score |
|---|---|---|
| | V1-HLA-A0201-10mers-282P1G3 Each peptide is a portion of SEQ ID NO: 15; each start position is specified, the length of peptide is 10 amino acids, and the end position for each peptide is the start position plus nine. | |
| 1110 | TLLLLTVCFV | 3255.381 |
| 274 | LLLECFAEGL | 1025.804 |
| 16 | FLLLKFSKAI | 674.752 |
| 1107 | ALLTLLLLTV | 591.888 |
| 118 | AMSEEIEFIV | 489.752 |
| 5 | LLGRGLIVYL | 459.398 |
| 9 | GLIVYLMFLL | 284.974 |
| 1189 | GLFSEDGSFI | 212.307 |
| 840 | TLVKVTWSTV | 118.238 |
| 132 | KLPKEKIDPL | 84.264 |
| 158 | GLPPLHIYWM | 62.845 |
| 1102 | LMCAIALLTL | 60.325 |
| 426 | ILANANIDVV | 54.634 |
| 957 | KLNGNLTGYL | 53.459 |
| 396 | VVFPREISFT | 51.883 |
| 897 | SLDAFSEFHL | 49.561 |
| 221 | KLTVNSLKHA | 39.992 |
| 150 | VLPCNPPKGL | 36.316 |
| 425 | TILANANIDV | 35.385 |
| 687 | TVILPLAPFV | 33.472 |
| 966 | LLQYQIINDT | 29.137 |
| 1101 | GLMCAIALLT | 27.572 |
| 267 | TILKGEILLL | 24.997 |
| 949 | TLSWGLPKKL | 21.362 |
| 792 | AVYAPYDVKV | 19.475 |
| 413 | AVYQCEASNV | 19.475 |
| 114 | KLGIAMSEEI | 17.892 |
| 13 | YLMFLLLKFS | 16.044 |
| 765 | VTWKPQGAPV | 13.630 |
| 1099 | FIGLMCAIAL | 13.512 |
| 470 | VVSWQKVEEV | 11.660 |
| 585 | IIIDGANLTI | 9.999 |
| 597 | VTLEDQGIYC | 9.787 |
| 693 | APFVRYQFRV | 9.743 |
| 36 | TIIKQSKVQV | 9.563 |
| 10 | LIVYLMFLLL | 9.488 |
| 1000 | NATTKYKFYL | 9.465 |
| 524 | NLDIRNATKL | 8.545 |
| 456 | SAFLHCEFFA | 8.144 |
| 1108 | LLTLLLLTVC | 7.964 |
| 341 | VIVEEPPRWT | 7.856 |
| 752 | KSMEQNGPGL | 7.404 |
| 859 | KGYQINWWKT | 6.947 |
| 541 | RIPKLHMLEL | 6.756 |
| 1105 | AIALLTLLLL | 6.756 |
| 8 | RGLIVYLMFL | 6.527 |
| 117 | IAMSEEIEFI | 5.649 |
| 25 | IEIPSSVQQV | 5.288 |
| 969 | YQIINDTYEI | 4.866 |
| 441 | IQTKDGENYA | 4.710 |
| 742 | KEMIIKWEPL | 4.481 |
| 332 | LGTATHDFHV | 4.477 |
| 615 | SAADITQVTV | 3.961 |
| 141 | LEVEEGDPIV | 3.865 |
| 480 | KPLEGRRYHI | 3.616 |
| 598 | TLEDQGIYCC | 2.998 |
| 1034 | GIGKISGVNL | 2.937 |
| 213 | TIVQKMPMKL | 2.937 |
| 862 | QINWWKTKSL | 2.937 |
| 356 | AVYSTGSNGI | 2.921 |
| 839 | STLVKVTWST | 2.872 |
| 953 | GLPKKLNGNL | 2.777 |
| 214 | IVQKMPMKLT | 2.550 |
| 461 | CEFFASPEAV | 2.452 |
| 833 | GVDVINSTLV | 2.434 |
| 3 | PLLLGRGLIV | 2.321 |

TABLE XI-continued

| Start | Subsequence | Score |
|---|---|---|
| 512 | VENAIGKTAV | 2.299 |
| 565 | KLSWSKDGEA | 2.260 |
| 1181 | VEYGEGDHGL | 2.260 |
| 987 | TTPSKPSWHL | 2.225 |
| 603 | GIYCCSAHTA | 2.186 |
| 61 | GNPEPTFSWT | 2.084 |
| 795 | APYDVKVQAI | 2.055 |
| 1100 | IGLMCAIALL | 2.017 |
| 218 | MPMKLTVNSL | 2.017 |
| 863 | INWWKTKSLL | 1.968 |
| 635 | HLSERQNRSV | 1.939 |
| 1172 | QPTESADSLV | 1.861 |
| 1171 | MQPTESADSL | 1.804 |
| 1008 | YLRACTSQGC | 1.737 |
| 405 | TNLQPNHTAV | 1.680 |
| 618 | DITQVTVLDV | 1.650 |
| 836 | VINSTLVKVT | 1.643 |
| 1043 | LTQKTHPIEV | 1.642 |
| 450 | ATVVGYSAFL | 1.632 |
| 907 | TVLAYNSKGA | 1.608 |
| 681 | VQGKKTTVIL | 1.510 |
| 334 | TATHDFHVIV | 1.505 |
| 1106 | IALLTLLLLT | 1.497 |
| 206 | AAFPRLRTIV | 1.465 |
| 452 | VVGYSAFLHC | 1.404 |
| 378 | IKWRVNGSPV | 1.363 |
| 181 | YMSQKGDLYF | 1.362 |
| 202 | YCCFAAFPRL | 1.219 |
| 171 | LEHIEQDERV | 1.127 |
| 1113 | LLTVCFVKRN | 1.107 |
| 835 | DVINSTLVKV | 1.050 |
| 934 | QPTFLKVIKV | 1.044 |
| 428 | ANANIDVVDV | 1.044 |
| 82 | RIIPSNNSGT | 1.025 |
| | V2-HLA-A0201-10mers-(SET 1)-282P1G3 Each peptide is a portion of SEQ ID NO: 5; each start position is specified, the length of peptide is 10 amino acids, and the end position for each peptide is the start position plus nine. | |
| 6 | SVPKFPKEKI | 0.447 |
| 9 | KFPKEKIDPL | 0.059 |
| 2 | FIVPSVPKFP | 0.052 |
| 3 | IVPSVPKFPK | 0.013 |
| 4 | VPSVPKFPKE | 0.000 |
| 10 | FPKEKIDPLE | 0.000 |
| 1 | EFIVPSVPKF | 0.000 |
| 5 | PSVPKFPKEK | 0.000 |
| 7 | VPKFPKEKID | 0.000 |
| 8 | PKFPKEKIDP | 0.000 |
| | V2-HLA-A0201-10mers-(SET 2)-282P1G3 Each peptide is a portion of SEQ ID NO: 5; each start position is specified, the length of peptide is 10 amino acids, and the end position for each peptide is the start position plus nine. | |
| 4 | TLGEGKYAGL | 131.379 |
| 2 | SSTLGEGKYA | 0.178 |
| 8 | GKYAGLYDDI | 0.034 |
| 3 | STLGEGKYAG | 0.004 |
| 6 | GEGKYAGLYD | 0.002 |
| 5 | LGEGKYAGLY | 0.000 |
| 1 | ESSTLGEGKY | 0.000 |
| 7 | EGKYAGLYDD | 0.000 |
| | V2-HLA-A0201-10mers-(SET 3)-282P1G3 Each peptide is a portion of SEQ ID NO: 5; each start position is specified, the length | |

TABLE XI-continued

| Start | Subsequence | Score |
|---|---|---|
| | of peptide is 10 amino acids, and the end position for each peptide is the start position plus nine. | |
| 5 | TLGEGKYAGL | 131.379 |
| 3 | SSTLGEGKYA | 0.178 |
| 9 | GKYAGLYDDI | 0.034 |
| 4 | STLGEGKYAG | 0.004 |
| 7 | GEGKYAGLYD | 0.002 |
| 1 | EESSTLGEGK | 0.000 |
| 10 | KYAGLYDDIS | 0.000 |
| 6 | LGEGKYAGLY | 0.000 |
| 2 | ESSTLGEGKY | 0.000 |
| 8 | EGKYAGLYDD | 0.000 |
| | V3-HLA-A0201-10mers-282P1G3 Each peptide is a portion of SEQ ID NO: 7; each start position is specified, the length of peptide is 10 amino acids, and the end position for each peptide is the start position plus nine. | |
| 11 | TTYVSNTTYV | 17.002 |
| 5 | GVDVINTTYV | 13.389 |
| 47 | MLAEDFIQKS | 4.540 |
| 8 | VINTTYVSNT | 4.006 |
| 2 | VIHGVDVINT | 4.006 |
| 53 | IQKSTSCNYV | 2.308 |
| 39 | ELSYRNRNML | 1.602 |
| 24 | TGSPQPSIFI | 0.375 |
| 25 | GSPQPSIFIC | 0.177 |
| 40 | LSYRNRNMLA | 0.176 |
| 22 | NATGSPQPSI | 0.145 |
| 62 | VEKSSTFFKI | 0.133 |
| 14 | VSNTTYVSNA | 0.127 |
| 9 | INTTYVSNTT | 0.083 |
| 46 | NMLAEDFIQK | 0.076 |
| 38 | QELSYRNRNM | 0.071 |
| 15 | SNTTYVSNAT | 0.049 |
| 58 | SCNYVEKSST | 0.049 |
| 52 | FIQKSTSCNY | 0.047 |
| 48 | LAEDFIQKST | 0.046 |
| 13 | YVSNTTYVSN | 0.045 |
| 31 | IFICSKEQEL | 0.025 |
| 32 | FICSKEQELS | 0.023 |
| 3 | IHGVDVINTT | 0.020 |
| 61 | YVEKSSTFFK | 0.012 |
| 19 | YVSNATGSPQ | 0.006 |
| 44 | NRNMLAEDFI | 0.004 |
| 30 | SIFICSKEQE | 0.004 |
| 17 | TTYVSNATGS | 0.003 |
| 50 | EDFIQKSTSC | 0.002 |
| 59 | CNYVEKSSTF | 0.002 |
| 36 | KEQELSYRNR | 0.001 |
| 56 | STSCNYVEKS | 0.001 |
| 10 | NTTYVSNTTY | 0.001 |
| 16 | NTTYVSNATG | 0.001 |
| 26 | SPQPSIFICS | 0.001 |
| 45 | RNMLAEDFIQ | 0.001 |
| 33 | ICSKEQELSY | 0.001 |
| 7 | DVINTTYVSN | 0.001 |
| 49 | AEDFIQKSTS | 0.001 |
| 55 | KSTSCNYVEK | 0.001 |
| 57 | TSCNYVEKSS | 0.000 |
| 21 | SNATGSPQPS | 0.000 |
| 23 | ATGSPQPSIF | 0.000 |
| 27 | PQPSIFICSK | 0.000 |
| 60 | NYVEKSSTFF | 0.000 |
| 34 | CSKEQELSYR | 0.000 |
| 20 | VSNATGSPQP | 0.000 |
| 28 | QPSIFICSKE | 0.000 |
| 6 | VDVINTTYVS | 0.000 |
| 4 | HGVDVINTTY | 0.000 |
| 1 | PVIHGVDVIN | 0.000 |

TABLE XI-continued

| Start | Subsequence | Score |
|---|---|---|
| 37 | EQELSYRNRN | 0.000 |
| 42 | YRNRNMLAED | 0.000 |
| 43 | RNRNMLAEDF | 0.000 |
| 54 | QKSTSCNYVE | 0.000 |
| 35 | SKEQELSYRN | 0.000 |
| 12 | TYVSNTTYVS | 0.000 |
| 51 | DFIQKSTSCN | 0.000 |
| 29 | PSIFICSKEQ | 0.000 |
| 41 | SYRNRNMLAE | 0.000 |
| 18 | TYVSNATGSP | 0.000 |
| | V4-HLA-0201-10mers-282P1G3 Each peptide is a portion of SEQ ID NO: 9; each start position is specified, the length of peptide is 10 amino acids, and the end position for each peptide is the start position plus nine. | |
| 1 | SVTLYSGEDL | 0.916 |
| 10 | LPEQPTFLKV | 0.094 |
| 3 | TLYSGEDLPE | 0.048 |
| 8 | EDLPEQPTFL | 0.045 |
| 9 | DLPEQPTFLK | 0.027 |
| 6 | SGEDLPEQPT | 0.013 |
| 5 | YSGEDLPEQP | 0.001 |
| 2 | VTLYSGEDLP | 0.001 |
| 7 | GEDLPEQPTF | 0.001 |
| 4 | LYSGEDLPEQ | 0.000 |
| | V5-HLA-0201-10mers-282P1G3 Each peptide is a portion of SEQ ID NO: 11; each start position is specified, the length of peptide is 10 amino acids, and the end position for each peptide is the start position plus nine. | |
| 4 | KLTVNSSNSI | 36.515 |
| 1 | MPMKLTVNSS | 0.007 |
| 6 | TVNSSNSIKQ | 0.001 |
| 3 | MKLTVNSSNS | 0.001 |
| 7 | VNSSNSIKQR | 0.000 |
| 5 | LTVNSSNSIK | 0.000 |
| 10 | SNSIKQRKPK | 0.000 |
| 8 | NSSNSIKQRK | 0.000 |
| 2 | PMKLTVNSSN | 0.000 |
| 9 | SSNSIKQRKP | 0.000 |
| | V6-HLA-0201-10mers-282P1G3 Each peptide is a portion of SEQ ID NO: 13; each start position is specified, the length of peptide is 10 amino acids, and the end position for each peptide is the start position plus nine. | |
| 2 | EEIEFIVPKL | 0.294 |
| 4 | IEFIVPKLEH | 0.009 |
| 6 | FIVPKLEHIE | 0.004 |
| 7 | IVPKLEHIEQ | 0.002 |
| 10 | KLEHIEQDER | 0.002 |
| 5 | EFIVPKLEHI | 0.001 |
| 1 | SEEIEFIVPK | 0.000 |
| 3 | EIEFIVPKLE | 0.000 |
| 9 | PKLEHIEQDE | 0.000 |
| 8 | VPKLEHIEQD | 0.000 |
| | V7-HLA-0201-10mers-282P1G3 Each peptide is a portion of SEQ ID NO: 15; each start position is specified, the length of peptide is 10 amino acids, and the end position for each | |

TABLE XI-continued

| Start | Subsequence | Score |
|---|---|---|
| | peptide is the start position plus nine. | |
| 18 | TLHPEPPRWT | 8.197 |
| 7 | IVEDNISHEL | 0.834 |
| 10 | DNISHELFTL | 0.140 |
| 6 | VIVEDNISHE | 0.033 |
| 11 | NISHELFTLH | 0.019 |
| 17 | FTLHPEPPRW | 0.018 |
| 9 | EDNISHELFT | 0.004 |
| 12 | ISHELFTLHP | 0.003 |
| 15 | ELFTLHPEPP | 0.002 |
| 19 | LHPEPPRWTK | 0.001 |
| 8 | VEDNISHELF | 0.000 |
| 3 | DFHVIVEDNI | 0.000 |
| 5 | HVIVEDNISH | 0.000 |
| 4 | FHVIVEDNIS | 0.000 |
| 14 | HELFTLHPEP | 0.000 |
| 16 | LFTLHPEPPR | 0.000 |
| 2 | HDFHVIVEDN | 0.000 |
| 1 | THDFHVIVED | 0.000 |
| 21 | PEPPRWTKKP | 0.000 |
| 13 | SHELFTLHPE | 0.000 |
| 20 | HPEPPRWTKK | 0.000 |

TABLE X

| Start | Subsequence | Score |
|---|---|---|
| | V1-HLA-A0201-9mers-282P1G3 Each peptide is a portion of SEQ ID NO: 3; each start position is specified, the length of peptide is 9 amino acids, and the end position for each peptide is the start position plus eight. | |
| 1111 | LLLLTVCFV | 5534.148 |
| 688 | VILPLAPFV | 330.846 |
| 1108 | LLTLLLLTV | 271.948 |
| 9 | GLIVYLMFL | 270.234 |
| 17 | LLLKFSKAI | 249.365 |
| 118 | AMSEEIEFI | 191.488 |
| 1101 | GLMCAIALL | 181.794 |
| 4 | LLLGRGLIV | 179.368 |
| 16 | FLLLKFSKA | 160.655 |
| 426 | ILANANIDV | 118.238 |
| 923 | YIFQTPEGV | 79.757 |
| 406 | NLQPNHTAV | 69.552 |
| 10 | LIVYLMFLL | 66.613 |
| 1107 | ALLTLLLLT | 63.417 |
| 840 | TLVKVTWST | 55.890 |
| 1027 | TLGEGSKGI | 42.774 |
| 930 | GVPEQPTFL | 42.151 |
| 47 | FPFDEYFQI | 41.346 |
| 166 | WMNIELEHI | 39.062 |
| 836 | VINSTLVKV | 37.393 |
| 125 | FIVPSVPKL | 31.077 |
| 591 | NLTISNVTL | 21.362 |
| 11 | IVYLMFLLL | 19.320 |
| 544 | KLHMLELHC | 17.388 |
| 1166 | SLNRDMQPT | 17.140 |
| 23 | KAIEIPSSV | 13.862 |
| 103 | FQGKYRCFA | 12.744 |
| 267 | TILKGEILL | 10.868 |
| 1042 | NLTQKTHPI | 10.433 |
| 451 | TVVGYSAFL | 10.281 |
| 1001 | ATTKYKFYL | 9.465 |
| 967 | LQYQIINDT | 9.453 |
| 1102 | LMCAIALLT | 9.149 |
| 787 | RMVTPAVYA | 8.846 |
| 1073 | SIFQDVIET | 8.720 |

TABLE X-continued

| Start | Subsequence | Score |
|---|---|---|
| 908 | VLAYNSKGA | 8.446 |
| 471 | VSWQKVEEV | 7.220 |
| 598 | TLEDQGIYC | 7.170 |
| 585 | IIIDGANLT | 7.142 |
| 335 | ATHDFHVIV | 6.171 |
| 680 | RVQGKKTTV | 6.086 |
| 780 | TVTNHTLRV | 6.086 |
| 333 | GTATHDFHV | 5.603 |
| 785 | TLRVMTPAV | 5.286 |
| 1092 | DISTQGWFI | 4.438 |
| 275 | LLECFAEGL | 4.328 |
| 1106 | IALLTLLLL | 4.292 |
| 14 | LMFLLLKFS | 4.282 |
| 458 | FLHCEFFAS | 3.778 |
| 619 | ITQVTVLDV | 3.777 |
| 174 | IEQDERVYM | 3.703 |
| 1033 | KGIGKISGV | 3.655 |
| 274 | LLLECFAEG | 3.651 |
| 774 | VEWEEETVT | 3.437 |
| 603 | GIYCCSAHT | 3.279 |
| 214 | IVQKMPMKL | 3.178 |
| 1105 | AIALLTLLL | 2.937 |
| 584 | RIIIDGANL | 2.937 |
| 268 | ILKGEILLL | 2.923 |
| 13 | YLMFLLLKF | 2.917 |
| 942 | KVDKDTATL | 2.617 |
| 1053 | FEPGAEHIV | 2.551 |
| 980 | ELNDINITT | 2.291 |
| 939 | KVIKVDKDT | 2.282 |
| 429 | NANIDVVDV | 2.222 |
| 589 | GANLTISNV | 2.222 |
| 611 | TALDSAADI | 2.198 |
| 976 | YEIGELNDI | 2.146 |
| 444 | KDGENYATV | 2.079 |
| 863 | INWWKTKSL | 1.968 |
| 950 | LSWGLPKKL | 1.968 |
| 83 | IIPSNNSGT | 1.742 |
| 26 | EIPSSVQQV | 1.650 |
| 916 | AGPESEPYI | 1.536 |
| 970 | QIINDTYEI | 1.435 |
| 819 | YSGEDYPDT | 1.376 |
| 280 | AEGLPTPQV | 1.352 |
| 1099 | FIGLMCAIA | 1.288 |
| 185 | KGDLYFANV | 1.208 |
| 374 | PQPTIKWRV | 1.164 |
| 991 | KPSWHLSNL | 1.123 |
| 988 | TPSKPSWHL | 1.046 |
| 272 | EILLLECFA | 1.043 |
| 846 | WSTVPKDRV | 1.023 |
| 753 | SMEQNGPGL | 0.987 |
| 203 | CCFAAFPRL | 0.980 |
| 586 | IIDGANLTI | 0.975 |
| 1066 | KNWGDNDSI | 0.969 |
| 252 | KLLLPPTES | 0.965 |
| 743 | EMIIKWEPL | 0.964 |
| 318 | YQDKGNYRC | 0.927 |
| 746 | IKWEPLKSM | 0.918 |
| 534 | RVSPKNPRI | 0.913 |
| 596 | NVTLEDQGI | 0.913 |
| 1100 | IGLMCAIAL | 0.877 |
| 210 | RLRTIVQKM | 0.868 |
| 736 | VQASQPKEM | 0.856 |
| 370 | AEGEPQPTI | 0.832 |
| 1214 | GSSTATFPL | 0.809 |
| 427 | LANANIDVV | 0.759 |
| | V2-HLA-A201-9mers-(SET 1)-282P1G3 Each peptide is a portion of SEQ ID NO: 5; each start position is specified, the length of peptide is 9 amino acids, and the end position for each peptide is the start position plus eight. | |
| 1 | FIVPSVPKF | 2.000 |
| 3 | VPSVPKFPK | 0.250 |

TABLE X-continued

| Start | Subsequence | Score |
|---|---|---|
| 5 | SVPKFPKEK | 0.020 |
| 4 | PSVPKFPKE | 0.003 |
| 2 | IVPSVPKFP | 0.001 |
| 6 | VPKFPKEKI | 0.000 |
| 9 | FPKEKIDPL | 0.000 |
| 7 | PKFPKEKID | 0.000 |
| 8 | KFPKEKIDP | 0.000 |
| | V2-HLA-A201-9mers-(SET 2)-282P1G3 Each peptide is a portion of SEQ ID NO: 5; each start position is specified, the length of peptide is 9 amino acids, and the end position for each peptide is the start position plus eight. | |
| 1 | GDLPKGREA | 0.005 |
| 9 | AKENYGKTL | 0.002 |
| 2 | DLPKGREAK | 0.001 |
| 7 | REAKENYGK | 0.000 |
| 5 | KGREAKENY | 0.000 |
| 8 | EAKENYGKT | 0.000 |
| 3 | LPKGREAKE | 0.000 |
| 6 | GREAKENYG | 0.000 |
| 4 | PKGREAKEN | 0.000 |
| | V2-HLA-A201-9mers-(SET 3)-282P1G3 Each peptide is a portion of SEQ ID NO: 5; each start position is specified, the length of peptide is 9 amino acids, and the end position for each peptide is the start position plus eight. | |
| 3 | STLGEGKYA | 1.404 |
| 4 | TLGEGKYAG | 0.306 |
| 5 | LGEGKYAGL | 0.023 |
| 9 | KYAGLYDDI | 0.004 |
| 6 | GEGKYAGLY | 0.000 |
| 8 | GKYAGLYDD | 0.000 |
| 2 | SSTLGEGKY | 0.000 |
| 1 | ESSTLGEGK | 0.000 |
| 7 | EGKYAGLYD | 0.000 |
| | V3-HLA-A201-9mers-282P1G3 Each peptide is a portion of SEQ ID NO: 7; each start position is specified, the length of peptide is 9 amino acids, and the end position for each peptide is the start position plus eight. | |
| 31 | FICSKEQEL | 13.512 |
| 5 | VDVINTTYV | 0.903 |
| 39 | LSYRNRNML | 0.759 |
| 44 | RNMLAEDFI | 0.679 |
| 53 | QKSTSCNYV | 0.531 |
| 24 | GSPQPSIFI | 0.375 |
| 46 | MLAEDFIQK | 0.197 |
| 8 | INTTYVSNT | 0.190 |
| 25 | SPQPSIFIC | 0.177 |
| 58 | CNYVEKSST | 0.156 |
| 22 | ATGSPQPSI | 0.145 |
| 9 | NTTYVSNTT | 0.104 |
| 15 | NTTYVSNAT | 0.104 |
| 45 | NMLAEDFIQ | 0.095 |
| 14 | SNTTYVSNA | 0.075 |
| 38 | ELSYRNRNM | 0.075 |
| 48 | AEDFIQKST | 0.058 |
| 11 | TYVSNTTYV | 0.053 |
| 51 | FIQKSTSCN | 0.047 |
| 7 | VINTTYVSN | 0.026 |
| 35 | KEQELSYRN | 0.021 |
| 2 | IHGVDVINT | 0.020 |

TABLE X-continued

| Start | Subsequence | Score |
|---|---|---|
| 3 | HGVDVINTT | 0.016 |
| 12 | YVSNTTYVS | 0.012 |
| 62 | EKSSTFFKI | 0.012 |
| 60 | YVEKSSTFF | 0.011 |
| 29 | SIFICSKEQ | 0.008 |
| 1 | VIHGVDVIN | 0.007 |
| 37 | QELSYRNRN | 0.005 |
| 47 | LAEDFIQKS | 0.004 |
| 10 | TTYVSNTTY | 0.003 |
| 16 | TTYVSNATG | 0.003 |
| 4 | GVDVINTTY | 0.003 |
| 13 | VSNTTYVSN | 0.001 |
| 21 | NATGSPQPS | 0.001 |
| 27 | QPSIFICSK | 0.001 |
| 18 | YVSNATGSP | 0.001 |
| 61 | VEKSSTFFK | 0.001 |
| 56 | TSCNYVEKS | 0.001 |
| 57 | SCNYVEKSS | 0.000 |
| 52 | IQKSTSCNY | 0.000 |
| 32 | ICSKEQELS | 0.000 |
| 26 | PQPSIFICS | 0.000 |
| 55 | STSCNYVEK | 0.000 |
| 50 | DFIQKSTSC | 0.000 |
| 6 | DVINTTYVS | 0.000 |
| 23 | TGSPQPSIF | 0.000 |
| 19 | VSNATGSPQ | 0.000 |
| 54 | KSTSCNYVE | 0.000 |
| 20 | SNATGSPQP | 0.000 |
| 33 | CSKEQELSY | 0.000 |
| 40 | SYRNRNMLA | 0.000 |
| 59 | NYVEKSSTF | 0.000 |
| 49 | EDFIQKSTS | 0.000 |
| 41 | YRNRNMLAE | 0.000 |
| 42 | RNRNMLAED | 0.000 |
| 34 | SKEQELSYR | 0.000 |
| 17 | TYVSNATGS | 0.000 |
| 30 | IFICSKEQE | 0.000 |
| 43 | NRNMLAEDF | 0.000 |
| 36 | EQELSYRNR | 0.000 |
| 28 | PSIFICSKE | 0.000 |
| | V4-HLA-A0201-9mers-282P1G3<br>Each peptide is a portion of SEQ ID NO: 9; each start position is specified, the length of peptide is 9 amino acids, and the end position for each peptide is the start position plus eight. | |
| 8 | DLPEQPTFL | 36.129 |
| 1 | VTLYSGEDL | 0.914 |
| 6 | GEDLPEQPT | 0.058 |
| 2 | TLYSGEDLP | 0.023 |
| 4 | YSGEDLPEQ | 0.004 |
| 9 | LPEQPTFLK | 0.000 |
| 7 | EDLPEQPTF | 0.000 |
| 5 | SGEDLPEQP | 0.000 |
| 3 | LYSGEDLPE | 0.000 |
| | V5-HLA-A0201-9mers-282P1G3<br>Each peptide is a portion of SEQ ID NO: 11; each start position is specified, the length of peptide is 9 amino acids, and the end position for each peptide is the start position plus eight. | |
| 3 | KLTVNSSNS | 0.261 |
| 4 | LTVNSSNSI | 0.246 |
| 2 | MKLTVNSSN | 0.001 |
| 5 | TVNSSNSIK | 0.001 |
| 7 | NSSNSIKQR | 0.000 |
| 6 | VNSSNSIKQ | 0.000 |
| 8 | SSNSIKQRK | 0.000 |
| 1 | PMKLTVNSS | 0.000 |

TABLE X-continued

| Start | Subsequence | Score |
|---|---|---|
| 9 | SNSIKQRKP | 0.000 |
| | V6-HLA-A0201-9mers-282P1G3<br>Each peptide is a portion of SEQ ID NO: 13; each start position is specified, the length of peptide is 9 amino acids, and the end position for each peptide is the start position plus eight. | |
| 5 | FIVPKLEHI | 7.437 |
| 2 | EIEFIVPKL | 0.032 |
| 9 | KLEHIEQDE | 0.003 |
| 3 | IEFIVPKLE | 0.002 |
| 6 | IVPKLEHIE | 0.001 |
| 1 | EEIEFIVPK | 0.001 |
| 8 | PKLEHIEQD | 0.000 |
| 7 | VPKLEHIEQ | 0.000 |
| 4 | EFIVPKLEH | 0.000 |
| | V7-HLA-A0201-9mers-282P1G3<br>Each peptide is a portion of SEQ ID NO: 15; each start position is specified, the length of peptide is 9 amino acids, and the end position for each peptide is the start position plus eight. | |
| 10 | NISHELFTL | 39.184 |
| 7 | VEDNISHEL | 0.282 |
| 17 | TLHPEPPRW | 0.075 |
| 5 | VIVEDNISH | 0.071 |
| 18 | LHPEPPRWT | 0.040 |
| 9 | DNISHELFT | 0.020 |
| 3 | FHVIVEDNI | 0.016 |
| 11 | ISHELFTLH | 0.006 |
| 14 | ELFTLHPEP | 0.004 |
| 16 | FTLHPEPPR | 0.004 |
| 6 | IVEDNISHE | 0.001 |
| 4 | HVIVEDNIS | 0.000 |
| 13 | HELFTLHPE | 0.000 |
| 20 | PEPPRWTKK | 0.000 |
| 15 | LFTLHPEPP | 0.000 |
| 1 | HDFHVIVED | 0.000 |
| 2 | DFHVIVEDN | 0.000 |
| 8 | EDNISHELF | 0.000 |
| 12 | SHELFTLHP | 0.000 |
| 19 | HPEPPRWTK | 0.000 |

TABLE XII

| Start | Subsequence | Score |
|---|---|---|
| | V1-HLA-A3-9mers-282P1G3<br>Each peptide is a portion of SEQ ID NO: 3; each start position is specified, the length of peptide is 9 amino acids, and the end position for each peptide is the start position plus eight. | |
| 760 | GLEYRVTWK | 180.000 |
| 1112 | LLLTVCFVK | 135.000 |
| 961 | NLTGYLLQY | 54.000 |
| 937 | FLKVIKVDK | 30.000 |
| 949 | TLSWGLPKK | 30.000 |
| 871 | LLDGRTHPK | 30.000 |
| 957 | KLNGNLTGY | 27.000 |
| 9 | GLIVYLMFL | 24.300 |
| 893 | GMVPSLDAF | 20.250 |

TABLE XII-continued

| Start | Subsequence | Score |
|---|---|---|
| 524 | NLDIRNATK | 20.000 |
| 547 | MLELHCESK | 20.000 |
| 792 | AVYAPYDVK | 15.000 |
| 5 | LLGRGLIVY | 12.000 |
| 1113 | LLTVCFVKR | 12.000 |
| 689 | ILPLAPFVR | 12.000 |
| 998 | NLNATTKYK | 10.000 |
| 744 | MIIKWEPLK | 9.000 |
| 1189 | GLFSEDGSF | 9.000 |
| 13 | YLMFLLLKF | 9.000 |
| 948 | ATLSWGLPK | 9.000 |
| 843 | KVTWSTVPK | 6.000 |
| 296 | DLPKGRETK | 6.000 |
| 213 | TIVQKMPMK | 4.500 |
| 149 | IVLPCNPPK | 4.500 |
| 661 | YIVEFEGNK | 4.050 |
| 1101 | GLMCAIALL | 4.050 |
| 181 | YMSQKGDLY | 4.000 |
| 310 | TLKIENVSY | 4.000 |
| 396 | VVFPREISF | 3.000 |
| 1110 | TLLLLTVCF | 3.000 |
| 530 | ATKLRVSPK | 3.000 |
| 268 | ILKGEILLL | 2.700 |
| 677 | ELTRVQGKK | 2.700 |
| 331 | FLGTATHDF | 2.000 |
| 11 | IVYLMFLLL | 1.800 |
| 275 | LLECFAEGL | 1.800 |
| 857 | RLKGYQINW | 1.800 |
| 739 | SQPKEMIIK | 1.800 |
| 44 | QVAFPFDEY | 1.800 |
| 835 | DVINSTLVK | 1.800 |
| 31 | VQQVPTIIK | 1.800 |
| 158 | GLPPLHIYW | 1.800 |
| 1197 | FIGAYAGSK | 1.800 |
| 1002 | TTKYKFYLR | 1.800 |
| 906 | LTVLAYNSK | 1.500 |
| 1199 | GAYAGSKEK | 1.500 |
| 859 | KGYQINWWK | 1.350 |
| 118 | AMSEEIEFI | 1.350 |
| 17 | LLLKFSKAI | 1.350 |
| 436 | DVRPLIQTK | 1.350 |
| 657 | NISEYIVEF | 1.350 |
| 861 | YQINWWKTK | 1.350 |
| 221 | KLTVNSLKH | 1.200 |
| 544 | KLHMLELHC | 1.200 |
| 129 | SVPKLPKEK | 1.000 |
| 166 | WMNIELEHI | 0.900 |
| 931 | VPEQPTFLK | 0.900 |
| 4 | LLLGRGLIV | 0.900 |
| 1111 | LLLLTVCFV | 0.900 |
| 1150 | GEYSDSDEK | 0.900 |
| 867 | KTKSLLDGR | 0.900 |
| 282 | GLPTPQVDW | 0.900 |
| 210 | RLRTIVQKM | 0.900 |
| 242 | KANSIKQRK | 0.900 |
| 16 | FLLLKFSKA | 0.900 |
| 1094 | STQGWFIGL | 0.810 |
| 840 | TLVKVTWST | 0.675 |
| 687 | TVILPLAPF | 0.675 |
| 520 | AVTANLDIR | 0.600 |
| 163 | HIYWMNIEL | 0.600 |
| 591 | NLTISNVTL | 0.600 |
| 983 | DINITTPSK | 0.600 |
| 1108 | LLTLLLLTV | 0.600 |
| 1042 | NLTQKTHPI | 0.600 |
| 127 | VPSVPKLPK | 0.600 |
| 897 | SLDAFSEFH | 0.600 |
| 1118 | FVKRNRGGK | 0.600 |
| 74 | NPFYFTDHR | 0.600 |
| 340 | HVIVEEPPR | 0.600 |
| 536 | SPKNPRIPK | 0.600 |
| 753 | SMEQNGPGL | 0.600 |
| 882 | NILRFSGQR | 0.540 |
| 392 | FAGDVVFPR | 0.540 |
| 562 | HSLKLSWSK | 0.450 |
| 284 | PTPQVDWNK | 0.450 |
| 853 | RVHGRLKGY | 0.450 |

TABLE XII-continued

| Start | Subsequence | Score |
|---|---|---|
| 45 | VAFPFDEYF | 0.450 |
| 1027 | TLGEGSKGI | 0.450 |
| 1088 | GLYDDISTQ | 0.450 |
| 1107 | ALLTLLLLT | 0.450 |
| 125 | FIVPSVPKL | 0.405 |
| 10 | LIVYLMFLL | 0.405 |
| 451 | TVVGYSAFL | 0.405 |
| 343 | VEEPPRWTK | 0.405 |
| 702 | VIAVNEVGR | 0.400 |
| 426 | ILANANIDV | 0.400 |
| 598 | TLEDQGIYC | 0.400 |
| 161 | PLHIYWMNI | 0.360 |
| 99 | HISHFQGKY | 0.360 |
| 458 | FLHCEFFAS | 0.360 |
| | V2-HLA-A3-9mers-(SET 1)-282P1G3<br>Each peptide is a portion of SEQ ID NO: 5; each start position is specified, the length of peptide is 9 amino acids, and the end position for each peptide is the start position plus eight. | |
| 5 | SVPKFPKEK | 3.000 |
| 1 | FIVPSVPKF | 1.350 |
| 3 | VPSVPKFPK | 0.900 |
| 9 | FPKEKIDPL | 0.013 |
| 6 | VPKFPKEKI | 0.009 |
| 2 | IVPSVPKFP | 0.002 |
| 8 | KFPKEKIDP | 0.000 |
| 4 | PSVPKFPKE | 0.000 |
| 7 | PKFPKEKID | 0.000 |
| | V2-HLA-A3-9mers-(SET 2)-282P1G3<br>Each peptide is a portion of SEQ ID NO: 5; each start position is specified, the length of peptide is 9 amino acids, and the end position for each peptide is the start position plus eight. | |
| 2 | DLPKGREAK | 6.000 |
| 7 | REAKENYGK | 0.180 |
| 5 | KGREAKENY | 0.018 |
| 9 | AKENYGKTL | 0.001 |
| 3 | LPKGREAKE | 0.000 |
| 1 | GDLPKGREA | 0.000 |
| 8 | EAKENYGKT | 0.000 |
| 6 | GREAKENYG | 0.000 |
| 4 | PKGREAKEN | 0.000 |
| | V2-HLA-A3-9mers-(SET 3)-282P1G3<br>Each peptide is a portion of SEQ ID NO: 5; each start position is specified, the length of peptide is 9 amino acids, and the end position for each peptide is the start position plus eight. | |
| 4 | TLGEGKYAG | 0.090 |
| 6 | GEGKYAGLY | 0.032 |
| 1 | ESSTLGEGK | 0.030 |
| 3 | STLGEGKYA | 0.011 |
| 2 | SSTLGEGKY | 0.006 |
| 9 | KYAGLYDDI | 0.003 |
| 8 | GKYAGLYDD | 0.001 |
| 5 | LGEGKYAGL | 0.001 |
| 7 | EGKYAGLYD | 0.000 |
| | V3-A3-9mers-282P1G3<br>Each peptide is a portion of SEQ ID NO: 7; each start position is specified, the length of peptide is 9 amino | |

TABLE XII-continued

| Start | Subsequence | Score |
|---|---|---|
| | acids, and the end position for each peptide is the start position plus eight. | |
| 46 | MLAEDFIQK | 180.000 |
| 4 | GVDVINTTY | 1.800 |
| 10 | TTYVSNTTY | 1.000 |
| 55 | STSCNYVEK | 1.000 |
| 27 | QPSIFICSK | 0.900 |
| 60 | YVEKSSTFF | 0.200 |
| 61 | VEKSSTFFK | 0.180 |
| 52 | IQKSTSCNY | 0.120 |
| 45 | NMLAEDFIQ | 0.090 |
| 33 | CSKEQELSY | 0.060 |
| 31 | FICSKEQEL | 0.060 |
| 22 | ATGSPQPSI | 0.045 |
| 24 | GSPQPSIFI | 0.027 |
| 39 | LSYRNRNML | 0.015 |
| 25 | SPQPSIFIC | 0.013 |
| 12 | YVSNTTYVS | 0.012 |
| 15 | NTTYVSNAT | 0.007 |
| 9 | NTTYVSNTT | 0.007 |
| 34 | SKEQELSYR | 0.007 |
| 38 | ELSYRNRNM | 0.006 |
| 6 | DVINTTYVS | 0.005 |
| 29 | SIFICSKEQ | 0.005 |
| 16 | TTYVSNATG | 0.005 |
| 59 | NYVEKSSTF | 0.005 |
| 1 | VIHGVDVIN | 0.005 |
| 14 | SNTTYVSNA | 0.004 |
| 36 | EQELSYRNR | 0.004 |
| 23 | TGSPQPSIF | 0.003 |
| 43 | NRNMLAEDF | 0.002 |
| 51 | FIQKSTSCN | 0.002 |
| 7 | VINTTYVSN | 0.002 |
| 44 | RNMLAEDFI | 0.002 |
| 8 | INTTYVSNT | 0.002 |
| 56 | TSCNYVEKS | 0.002 |
| 47 | LAEDFIQKS | 0.002 |
| 62 | EKSSTFFKI | 0.002 |
| 26 | PQPSIFICS | 0.001 |
| 58 | CNYVEKSST | 0.001 |
| 54 | KSTSCNYVE | 0.001 |
| 35 | KEQELSYRN | 0.001 |
| 21 | NATGSPQPS | 0.001 |
| 18 | YVSNATGSP | 0.001 |
| 2 | IHGVDVINT | 0.001 |
| 32 | ICSKEQELS | 0.000 |
| 40 | SYRNRNMLA | 0.000 |
| 3 | HGVDVINTT | 0.000 |
| 5 | VDVINTTYV | 0.000 |
| 11 | TYVSNTTYV | 0.000 |
| 57 | SCNYVEKSS | 0.000 |
| 37 | QELSYRNRN | 0.000 |
| 48 | AEDFIQKST | 0.000 |
| 53 | QKSTSCNYV | 0.000 |
| 19 | VSNATGSPQ | 0.000 |
| 13 | VSNTTYVSN | 0.000 |
| 50 | DFIQKSTSC | 0.000 |
| 42 | RNRNMLAED | 0.000 |
| 17 | TYVSNATGS | 0.000 |
| 41 | YRNRNMLAE | 0.000 |
| 49 | EDFIQKSTS | 0.000 |
| 20 | SNATGSPQP | 0.000 |
| 30 | IFICSKEQE | 0.000 |
| 28 | PSIFICSKE | 0.000 |
| | V4-HLA-A3-9mers-282P1G3 Each peptide is a portion of SEQ ID NO: 9; each start position is specified, the length of peptide is 9 amino acids, and the end position for each peptide is the start position plus eight. | |
| 9 | LPEQPTFLK | 0.900 |
| 8 | DLPEQPTFL | 0.270 |
| 2 | TLYSGEDLP | 0.100 |
| 1 | VTLYSGEDL | 0.045 |
| 7 | EDLPEQPTF | 0.001 |
| 6 | GEDLPEQPT | 0.001 |
| 4 | YSGEDLPEQ | 0.000 |
| 3 | LYSGEDLPE | 0.000 |
| 5 | SGEDLPEQP | 0.000 |
| | V5-HLA-A3-9mers-282P1G3 Each peptide is a portion of SEQ ID NO: 11; each start position is specified, the length of peptide is 9 amino acids, and the end position for each peptide is the start position plus eight. | |
| 5 | TVNSSNSIK | 2.000 |
| 8 | SSNSIKQRK | 0.150 |
| 3 | KLTVNSSNS | 0.120 |
| 4 | LTVNSSNSI | 0.045 |
| 7 | NSSNSIKQR | 0.015 |
| 1 | PMKLTVNSS | 0.012 |
| 6 | VNSSNSIKQ | 0.000 |
| 2 | MKLTVNSSN | 0.000 |
| 9 | SNSIKQRKP | 0.000 |
| | V6-HLA-A3-9mers-282P1G3 Each peptide is a portion of SEQ ID NO: 13; each start position is specified, the length of peptide is 9 amino acids, and the end position for each peptide is the start position plus eight. | |
| 5 | FIVPKLEHI | 0.203 |
| 1 | EEIEFIVPK | 0.182 |
| 9 | KLEHIEQDE | 0.090 |
| 2 | EIEFIVPKL | 0.081 |
| 6 | IVPKLEHIE | 0.002 |
| 7 | VPKLEHIEQ | 0.000 |
| 4 | EFIVPKLEH | 0.000 |
| 3 | IEFIVPKLE | 0.000 |
| 8 | PKLEHIEQD | 0.000 |
| | V7-HLA-A3-9mers-282P1G3 Each peptide is a portion of SEQ ID NO: 15; each start position is specified, the length of peptide is 9 amino acids, and the end position for each peptide is the start position plus eight. | |
| 19 | HPEPPRWTK | 1.350 |
| 16 | FTLHPEPPR | 0.450 |
| 17 | TLHPEPPRW | 0.300 |
| 10 | NISHELFTL | 0.270 |
| 5 | VIVEDNISH | 0.090 |
| 14 | ELFTLHPEP | 0.030 |
| 20 | PEPPRWTKK | 0.009 |
| 4 | HVIVEDNIS | 0.006 |
| 11 | ISHELFTLH | 0.005 |
| 6 | IVEDNISHE | 0.003 |
| 7 | VEDNISHEL | 0.003 |
| 3 | FHVIVEDNI | 0.001 |
| 8 | EDNISHELF | 0.001 |
| 1 | HDFHVIVED | 0.000 |
| 9 | DNISHELFT | 0.000 |
| 13 | HELFTLHPE | 0.000 |
| 12 | SHELFTLHP | 0.000 |
| 2 | DFHVIVEDN | 0.000 |
| 18 | LHPEPPRWT | 0.000 |
| 15 | LFTLHPEPP | 0.000 |

TABLE XIII

| Start | Subsequence | Score |
|---|---|---|
| | V1-HLA-A3-10mers-282P1G3 Each peptide is a portion of SEQ ID NO: 3; each start position is specified, the length of peptide is 10 amino acids, and the end position for each peptide is the start position plus nine. | |
| 14 | LMFLLLKFSK | 300.000 |
| 1111 | LLLLTVCFVK | 135.000 |
| 11 | IVYLMFLLLK | 90.000 |
| 187 | DLYFANVEEK | 90.000 |
| 546 | HMLELHCESK | 45.000 |
| 930 | GVPEQPTFLK | 40.500 |
| 870 | SLLDGRTHPK | 30.000 |
| 743 | EMIIKWEPLK | 27.000 |
| 4 | LLLGRGLIVY | 27.000 |
| 995 | HLSNLNATTK | 20.000 |
| 905 | HLTVLAYNSK | 20.000 |
| 532 | KLRVSPKNPR | 18.000 |
| 1112 | LLLTVCFVKR | 18.000 |
| 689 | ILPLAPFVRY | 18.000 |
| 342 | IVEEPPRWTK | 13.500 |
| 1037 | KISGVNLTQK | 13.500 |
| 9 | GLIVYLMFLL | 12.150 |
| 788 | VMTPAVYAPY | 9.000 |
| 1189 | GLFSEDGSFI | 9.000 |
| 312 | KIENVSYQDK | 6.000 |
| 30 | SVQQVPTIIK | 6.000 |
| 406 | NLQPNHTAVY | 6.000 |
| 126 | IVPSVPKLPK | 6.000 |
| 998 | NLNATTKYKF | 6.000 |
| 1073 | SIFQDVIETR | 4.500 |
| 274 | LLLECFAEGL | 4.050 |
| 158 | GLPPLHIYWM | 4.050 |
| 633 | NLHLSERQNR | 4.000 |
| 181 | YMSQKGDLYF | 4.000 |
| 785 | TLRVMTPAVY | 4.000 |
| 33 | QVPTIIKQSK | 3.000 |
| 219 | PMKLTVNSLK | 3.000 |
| 62 | NPEPTFSWTK | 2.700 |
| 132 | KLPKEKIDPL | 2.700 |
| 688 | VILPLAPFVR | 2.700 |
| 212 | RTIVQKMPMK | 2.250 |
| 948 | ATLSWGLPKK | 2.250 |
| 509 | SCWVENAIGK | 2.000 |
| 733 | NIRVQASQPK | 2.000 |
| 1102 | LMCAIALLTL | 1.800 |
| 1001 | ATTKYKFYLR | 1.800 |
| 897 | SLDAFSEFHL | 1.800 |
| 114 | KLGIAMSEEI | 1.800 |
| 1101 | GLMCAIALLT | 1.350 |
| 118 | AMSEEIEFIV | 1.350 |
| 691 | PLAPFVRYQF | 1.350 |
| 16 | FLLLKFSKAI | 1.350 |
| 283 | LPTPQVDWNK | 1.350 |
| 18 | LLKFSKAIEI | 1.200 |
| 170 | ELEHIEQDER | 1.200 |
| 848 | TVPKDRVHGR | 1.200 |
| 116 | GIAMSEEIEF | 1.200 |
| 947 | TATLSWGLPK | 1.200 |
| 105 | GKYRCFASNK | 0.900 |
| 967 | LQYQIINDTY | 0.900 |
| 5 | LLGRGLIVYL | 0.900 |
| 488 | HIYENGTLQI | 0.900 |
| 466 | SPEAVVSWQK | 0.900 |
| 598 | TLEDQGIYCC | 0.900 |
| 261 | GSESSITILK | 0.900 |
| 1107 | ALLTLLLLTV | 0.900 |
| 292 | KIGGDLPKGR | 0.900 |
| 1110 | TLLLLTVCFV | 0.900 |
| 309 | KTLKIENVSY | 0.900 |
| 957 | KLNGNLTGYL | 0.810 |
| 43 | VQVAFPFDEY | 0.810 |
| 471 | VSWQKVEEVK | 0.750 |

TABLE XIII-continued

| Start | Subsequence | Score |
|---|---|---|
| 844 | VTWSTVPKDR | 0.750 |
| 481 | PLEGRRYHIY | 0.600 |
| 524 | NLDIRNATKL | 0.600 |
| 44 | QVAFPFDEYF | 0.600 |
| 529 | NATKLRVSPK | 0.600 |
| 701 | RVIAVNEVGR | 0.600 |
| 238 | EIGSKANSIK | 0.600 |
| 810 | GPDPQSVTLY | 0.540 |
| 10 | LIVYLMFLLL | 0.540 |
| 953 | GLPKKLNGNL | 0.540 |
| 738 | ASQPKEMIIK | 0.450 |
| 857 | RLKGYQINWW | 0.450 |
| 221 | KLTVNSLKHA | 0.450 |
| 123 | IEFIVPSVPK | 0.450 |
| 1088 | GLYDDISTQG | 0.450 |
| 150 | VLPCNPPKGL | 0.450 |
| 1136 | HPDPEIQSVK | 0.450 |
| 440 | LIQTKDGENY | 0.400 |
| 815 | SVTLYSGEDY | 0.400 |
| 559 | HLKHSLKLSW | 0.400 |
| 902 | SEFHLTVLAY | 0.360 |
| 1143 | SVKDETFGEY | 0.360 |
| 686 | TTVILPLAPF | 0.338 |
| 960 | GNLTGYLLQY | 0.324 |
| 148 | PIVLPCNPPK | 0.300 |
| 1108 | LLTLLLLTVC | 0.300 |
| 356 | AVYSTGSNGI | 0.300 |
| 426 | ILANANIDVV | 0.300 |
| 817 | TLYSGEDYPD | 0.300 |
| 535 | VSPKNPRIPK | 0.300 |
| 69 | WTKDGNPFYF | 0.300 |
| 840 | TLVKVTWSTV | 0.300 |
| 603 | GIYCCSAHTA | 0.300 |
| | V2-HLA-A3-10mers-(SET 1)-282P1G3 Each peptide is a portion of SEQ ID NO: 5; each start position is specified, the length of peptide is 10 amino acids, and the end position for each peptide is the start position plus nine. | |
| 3 | IVPSVPKFPK | 9.000 |
| 6 | SVPKFPKEKI | 0.090 |
| 5 | PSVPKFPKEK | 0.034 |
| 2 | FIVPSVPKFP | 0.003 |
| 9 | KFPKEKIDPL | 0.003 |
| 1 | EFIVPSVPKF | 0.003 |
| 4 | VPSVPKFPKE | 0.001 |
| 10 | FPKEKIDPLE | 0.000 |
| 7 | VPKFPKEKID | 0.000 |
| 8 | PKFPKEKIDP | 0.000 |
| | V2-HLA-A3-10mers-(SET 2)-282P1G3 Each peptide is a portion of SEQ ID NO: 5; each start position is specified, the length of peptide is 10 amino acids, and the end position for each peptide is the start position plus nine. | |
| 4 | TLGEGKYAGL | 0.900 |
| 8 | GKYAGLYDDI | 0.009 |
| 3 | STLGEGKYAG | 0.007 |
| 5 | LGEGKYAGLY | 0.005 |
| 1 | ESSTLGEGKY | 0.002 |
| 2 | SSTLGEGKYA | 0.001 |
| 6 | GEGKYAGLYD | 0.000 |
| 7 | EGKYAGLYDD | 0.000 |
| | V2-HLA-A3-10mers-(SET 3)-282P1G3 Each peptide is a portion of SEQ ID NO: 5; each start position is specified, the length of peptide is 10 amino acids, | |

TABLE XIII-continued

| Start | Subsequence | Score |
|---|---|---|
| | and the end position for each peptide is the start position plus nine. | |
| 5 | TLGEGKYAGL | 0.900 |
| 1 | EESSTLGEGK | 0.018 |
| 9 | GKYAGLYDDI | 0.009 |
| 4 | STLGEGKYAG | 0.007 |
| 6 | LGEGKYAGLY | 0.005 |
| 2 | ESSTLGEGKY | 0.002 |
| 10 | KYAGLYDDIS | 0.001 |
| 3 | SSTLGEGKYA | 0.001 |
| 7 | GEGKYAGLYD | 0.000 |
| 8 | EGKYAGLYDD | 0.000 |
| | V3-HLA-A3-10mers-282P1G3 Each peptide is a portion of SEQ ID NO: 7; each start position is specified, the length of peptide is 10 amino acids, and the end position for each peptide is the start position plus nine. | |
| 46 | NMLAEDFIQK | 180.000 |
| 61 | YVEKSSTFFK | 6.000 |
| 52 | FIQKSTSCNY | 0.400 |
| 55 | KSTSCNYVEK | 0.300 |
| 47 | MLAEDFIQKS | 0.270 |
| 27 | PQPSIFICSK | 0.270 |
| 10 | NTTYVSNTTY | 0.200 |
| 39 | ELSYRNRNML | 0.180 |
| 23 | ATGSPQPSIF | 0.100 |
| 8 | VINTTYVSNT | 0.090 |
| 2 | VIHGVDVINT | 0.090 |
| 33 | ICSKEQELSY | 0.080 |
| 5 | GVDVINTTYV | 0.060 |
| 11 | TTYVSNTTYV | 0.050 |
| 34 | CSKEQELSYR | 0.045 |
| 59 | CNYVEKSSTF | 0.020 |
| 56 | STSCNYVEKS | 0.018 |
| 62 | VEKSSTFFKI | 0.016 |
| 25 | GSPQPSIFIC | 0.013 |
| 22 | NATGSPQPSI | 0.013 |
| 30 | SIFICSKEQE | 0.010 |
| 17 | TTYVSNATGS | 0.010 |
| 40 | LSYRNRNMLA | 0.010 |
| 4 | HGVDVINTTY | 0.009 |
| 14 | VSNTTYVSNA | 0.009 |
| 53 | IQKSTSCNYV | 0.006 |
| 26 | SPQPSIFICS | 0.005 |
| 36 | KEQELSYRNR | 0.005 |
| 60 | NYVEKSSTFF | 0.005 |
| 32 | FICSKEQELS | 0.004 |
| 43 | RNRNMLAEDF | 0.004 |
| 24 | TGSPQPSIFI | 0.003 |
| 19 | YVSNATGSPQ | 0.002 |
| 13 | YVSNTTYVSN | 0.002 |
| 16 | NTTYVSNATG | 0.001 |
| 58 | SCNYVEKSST | 0.001 |
| 31 | IFICSKEQEL | 0.001 |
| 7 | DVINTTYVSN | 0.001 |
| 48 | LAEDFIQKST | 0.001 |
| 44 | NRNMLAEDFI | 0.001 |
| 37 | EQELSYRNRN | 0.001 |
| 1 | PVIHGVDVIN | 0.000 |
| 28 | QPSIFICSKE | 0.000 |
| 15 | SNTTYVSNAT | 0.000 |
| 9 | INTTYVSNTT | 0.000 |
| 50 | EDFIQKSTSC | 0.000 |
| 3 | IHGVDVINTT | 0.000 |
| 45 | RNMLAEDFIQ | 0.000 |
| 12 | TYVSNTTYVS | 0.000 |
| 6 | VDVINTTYVS | 0.000 |
| 57 | TSCNYVEKSS | 0.000 |
| 49 | AEDFIQKSTS | 0.000 |
| 20 | VSNATGSPQP | 0.000 |

TABLE XIII-continued

| Start | Subsequence | Score |
|---|---|---|
| 38 | QELSYRNRNM | 0.000 |
| 21 | SNATGSPQPS | 0.000 |
| 35 | SKEQELSYRN | 0.000 |
| 54 | QKSTSCNYVE | 0.000 |
| 41 | SYRNRNMLAE | 0.000 |
| 42 | YRNRNMLAED | 0.000 |
| 18 | TYVSNATGSP | 0.000 |
| 51 | DFIQKSTSCN | 0.000 |
| 29 | PSIFICSKEQ | 0.000 |
| | V4-HLA-A3-10mers-282P1G3 Each peptide is a portion of SEQ ID NO: 9; each start position is specified, the length of peptide is 10 amino acids, and the end position for each peptide is the start position plus nine. | |
| 9 | DLPEQPTFLK | 40.500 |
| 3 | TLYSGEDLPE | 0.200 |
| 1 | SVTLYSGEDL | 0.060 |
| 7 | GEDLPEQPTF | 0.018 |
| 10 | LPEQPTFLKV | 0.012 |
| 2 | VTLYSGEDLP | 0.002 |
| 8 | EDLPEQPTFL | 0.000 |
| 6 | SGEDLPEQPT | 0.000 |
| 5 | YSGEDLPEQP | 0.000 |
| 4 | LYSGEDLPEQ | 0.000 |
| | V5-HLA-A3-10mers-282P1G3 Each peptide is a portion of SEQ ID NO: 11; each start position is specified, the length of peptide is 10 amino acids, and the end position for each peptide is the start position plus nine. | |
| 4 | KLTVNSSNSI | 1.800 |
| 5 | LTVNSSNSIK | 1.500 |
| 8 | NSSNSIKQRK | 0.150 |
| 10 | SNSIKQRKPK | 0.020 |
| 7 | VNSSNSIKQR | 0.006 |
| 6 | TVNSSNSIKQ | 0.004 |
| 2 | PMKLTVNSSN | 0.003 |
| 1 | MPMKLTVNSS | 0.002 |
| 3 | MKLTVNSSNS | 0.000 |
| 9 | SSNSIKQRKP | 0.000 |
| | V6-HLA-A3-10mers-282P1G3 Each peptide is a portion of SEQ ID NO: 13; each start position is specified, the length of peptide is 10 amino acids, and the end position for each peptide is the start position plus nine. | |
| 10 | KLEHIEQDER | 12.000 |
| 1 | SEEIEFIVPK | 0.270 |
| 4 | IEFIVPKLEH | 0.009 |
| 2 | EEIEFIVPKL | 0.005 |
| 6 | FIVPKLEHIE | 0.005 |
| 7 | IVPKLEHIEQ | 0.004 |
| 3 | EIEFIVPKLE | 0.000 |
| 5 | EFIVPKLEHI | 0.000 |
| 8 | VPKLEHIEQD | 0.000 |
| 9 | PKLEHIEQDE | 0.000 |
| | V7-HLA-A3-10mers-282P1G3 Each peptide is a portion of SEQ ID NO: 15; each start position is specified, the length of peptide is 10 amino acids, and the end position for each | |

TABLE XIII-continued

| Start | Subsequence | Score |
|---|---|---|
| | peptide is the start position plus nine. | |
| 20 | HPEPPRWTKK | 0.300 |
| 19 | LHPEPPRWTK | 0.135 |
| 7 | IVEDNISHEL | 0.090 |
| 11 | NISHELFTLH | 0.060 |
| 5 | HVIVEDNISH | 0.060 |
| 15 | ELFTLHPEPP | 0.030 |
| 18 | TLHPEPPRWT | 0.022 |
| 17 | FTLHPEPPRW | 0.015 |
| 6 | VIVEDNISHE | 0.007 |
| 16 | LFTLHPEPPR | 0.006 |
| 8 | VEDNISHELF | 0.006 |
| 10 | DNISHELFTL | 0.002 |
| 12 | ISHELFTLHP | 0.001 |
| 2 | HDFHVIVEDN | 0.000 |
| 3 | DFHVIVEDNI | 0.000 |
| 14 | HELFTLHPEP | 0.000 |
| 4 | FHVIVEDNIS | 0.000 |
| 9 | EDNISHELFT | 0.000 |
| 1 | THDFHVIVED | 0.000 |
| 13 | SHELFTLHPE | 0.000 |
| 21 | PEPPRWTKKP | 0.000 |

TABLE XIV

| Start | Subsequence | Score |
|---|---|---|
| | V1-HLA-A1101-9mers-282P1G3 Each peptide is a portion of SEQ ID NO: 3; each start position is specified, the length of peptide is 9 amino acids and the end position for each peptide is the start position plus eight. | |
| 843 | KVTWSTVPK | 6.000 |
| 792 | AVYAPYDVK | 4.000 |
| 149 | IVLPCNPPK | 3.000 |
| 948 | ATLSWGLPK | 3.000 |
| 1118 | FVKRNRGGK | 2.000 |
| 835 | DVINSTLVK | 1.800 |
| 1112 | LLLTVCFVK | 1.800 |
| 906 | LTVLAYNSK | 1.500 |
| 739 | SQPKEMIIK | 1.200 |
| 760 | GLEYRVTWK | 1.200 |
| 12 | VYLMFLLLK | 1.200 |
| 106 | KYRCFASNK | 1.200 |
| 31 | VQQVPTIIK | 1.200 |
| 129 | SVPKLPKEK | 1.000 |
| 530 | ATKLRVSPK | 1.000 |
| 15 | MFLLLKFSK | 0.900 |
| 188 | LYFANVEEK | 0.800 |
| 1199 | GAYAGSKEK | 0.600 |
| 436 | DVRPLIQTK | 0.600 |
| 340 | HVIVEEPPR | 0.600 |
| 744 | MIIKWEPLK | 0.600 |
| 931 | VPEQPTFLK | 0.600 |
| 242 | KANSIKQRK | 0.600 |
| 661 | YIVEFEGNK | 0.600 |
| 867 | KTKSLLDGR | 0.600 |
| 213 | TIVQKMPMK | 0.600 |
| 861 | YQINWWKTK | 0.450 |
| 127 | VPSVPKLPK | 0.400 |
| 536 | SPKNPRIPK | 0.400 |
| 871 | LLDGRTHPK | 0.400 |
| 937 | FLKVIKVDK | 0.400 |
| 547 | MLELHCESK | 0.400 |
| 524 | NLDIRNATK | 0.400 |
| 520 | AVTANLDIR | 0.400 |
| 1002 | TTKYKFYLR | 0.400 |

TABLE XIV-continued

| Start | Subsequence | Score |
|---|---|---|
| 949 | TLSWGLPKK | 0.400 |
| 1197 | FIGAYAGSK | 0.400 |
| 1150 | GEYSDSDEK | 0.360 |
| 301 | RETKENYGK | 0.360 |
| 1029 | GEGSKGIGK | 0.360 |
| 859 | KGYQINWWK | 0.240 |
| 689 | ILPLAPFVR | 0.240 |
| 34 | VPTIIKQSK | 0.200 |
| 52 | YFQIECEAK | 0.200 |
| 934 | QPTFLKVIK | 0.200 |
| 1011 | ACTSQGCGK | 0.200 |
| 998 | NLNATTKYK | 0.200 |
| 284 | PTPQVDWNK | 0.200 |
| 304 | KENYGKTLK | 0.180 |
| 787 | RVMTPAVYA | 0.120 |
| 983 | DINITTPSK | 0.120 |
| 262 | SESSITILK | 0.120 |
| 478 | EVKPLEGRR | 0.120 |
| 392 | FAGDVVFPR | 0.120 |
| 343 | VEEPPRWTK | 0.120 |
| 296 | DLPKGRETK | 0.120 |
| 882 | NILRFSGQR | 0.120 |
| 202 | YCCFAAFPR | 0.120 |
| 677 | ELTRVQGKK | 0.120 |
| 98 | GHISHFQGK | 0.090 |
| 333 | GTATHDFHV | 0.090 |
| 212 | RTIVQKMPM | 0.090 |
| 779 | ETVTNHTLR | 0.090 |
| 124 | EFIVPSVPK | 0.090 |
| 702 | VIAVNEVGR | 0.080 |
| 74 | NPFYFTDHR | 0.080 |
| 11 | IVYLMFLLL | 0.080 |
| 877 | HPKEVNILR | 0.080 |
| 1113 | LLTVCFVKR | 0.080 |
| 396 | VVFPREISF | 0.080 |
| 693 | APFVRYQFR | 0.080 |
| 317 | SYQDKGNYR | 0.080 |
| 562 | HSLKLSWSK | 0.060 |
| 291 | NKIGGDLPK | 0.060 |
| 510 | CWVENAIGK | 0.060 |
| 680 | RVQGKKTTV | 0.060 |
| 764 | RVTWKPQGA | 0.060 |
| 942 | KVDKDTATL | 0.060 |
| 721 | ETPPAAPDR | 0.060 |
| 534 | RVSPKNPRI | 0.060 |
| 930 | GVPEQPTFL | 0.060 |
| 833 | GVDVINSTL | 0.060 |
| 313 | IENVSYQDK | 0.060 |
| 452 | VVGYSAFLH | 0.060 |
| 579 | GTEDGRIII | 0.060 |
| 424 | GTILANANI | 0.045 |
| 1115 | TVCFVKRNR | 0.040 |
| 780 | TVTNHTLRV | 0.040 |
| 214 | IVQKMPMKL | 0.040 |
| 849 | VPKDRVHGR | 0.040 |
| 1074 | IFQDVIETR | 0.040 |
| 9 | GLIVYLMFL | 0.036 |
| 247 | KQRKPKLLL | 0.036 |
| 734 | IRVQASQPK | 0.030 |
| 220 | MKLTVNSLK | 0.030 |
| 1124 | GGKYSVKEK | 0.030 |
| 685 | KTTVILPLA | 0.030 |
| 687 | TVILPLAPF | 0.030 |
| 1001 | ATTKYKFYL | 0.030 |
| 875 | RTHPKEVNI | 0.030 |
| | V2-HLA-A-1101-9mers-(SET 1)-282P1G3 Each peptide is a portion of SEQ ID NO: 5; each start position is specified, the length of peptide is 9 amino acids, and the end position for each peptide is the start position plus eight. | |
| 5 | SVPKFPKEK | 1.000 |
| 3 | VPSVPKFPK | 0.600 |

TABLE XIV-continued

| Start | Subsequence | Score |
|---|---|---|
| 1 | FIVPSVPKF | 0.006 |
| 6 | VPKFPKEKI | 0.002 |
| 9 | FPKEKIDPL | 0.002 |
| 8 | KFPKEKIDP | 0.001 |
| 2 | IVPSVPKFP | 0.001 |
| 4 | PSVPKFPKE | 0.000 |
| 7 | PKFPKEKID | 0.000 |
| | V2-HLA-A-1101-9mers-(SET 2)-282P1G3 Each peptide is a portion of SEQ ID NO: 5; each start position is specified, the length of peptide is 9 amino acids, and the end position for each peptide is the start position plus eight. | |
| 7 | REAKENYGK | 0.360 |
| 2 | DLPKGREAK | 0.120 |
| 5 | KGREAKENY | 0.001 |
| 3 | LPKGREAKE | 0.000 |
| 9 | AKENYGKTL | 0.000 |
| 1 | GDLPKGREA | 0.000 |
| 6 | GREAKENYG | 0.000 |
| 8 | EAKENYGKT | 0.000 |
| 4 | PKGREAKEN | 0.000 |
| | V2-HLA-A-1101-9mers-(SET 3)-282P1G3 Each peptide is a portion of SEQ ID NO: 5; each start position is specified, the length of peptide is 9 amino acids, and the end position for each peptide is the start position plus eight. | |
| 9 | KYAGLYDDI | 0.012 |
| 3 | STLGEGKYA | 0.007 |
| 1 | ESSTLGEGK | 0.006 |
| 6 | GEGKYAGLY | 0.002 |
| 4 | TLGEGKYAG | 0.001 |
| 8 | GKYAGLYDD | 0.000 |
| 5 | LGEGKYAGL | 0.000 |
| 2 | SSTLGEGKY | 0.000 |
| 7 | EGKYAGLYD | 0.000 |
| | V3-A1101-9mers-282P1G3 Each peptide is a portion of SEQ ID NO: 7; each start position is specified, the length of peptide is 9 amino acids, and the end position for each peptide is the start position plus eight. | |
| 55 | STSCNYVEK | 1.000 |
| 46 | MLAEDFIQK | 0.800 |
| 27 | QPSIFICSK | 0.200 |
| 61 | VEKSSTFFK | 0.180 |
| 4 | GVDVINTTY | 0.060 |
| 60 | YVEKSSTFF | 0.020 |
| 10 | TTYVSNTTY | 0.020 |
| 22 | ATGSPQPSI | 0.010 |
| 40 | SYRNRNMLA | 0.008 |
| 52 | IQKSTSCNY | 0.006 |
| 59 | NYVEKSSTF | 0.006 |
| 11 | TYVSNTTYV | 0.006 |
| 12 | YVSNTTYVS | 0.004 |
| 31 | FICSKEQEL | 0.004 |
| 34 | SKEQELSYR | 0.004 |
| 36 | EQELSYRNR | 0.004 |
| 44 | RNMLAEDFI | 0.002 |
| 18 | YVSNATGSP | 0.002 |
| 16 | TTYVSNATG | 0.002 |
| 45 | NMLAEDFIQ | 0.002 |
| 6 | DVINTTYVS | 0.002 |
| 24 | GSPQPSIFI | 0.001 |

TABLE XIV-continued

| Start | Subsequence | Score |
|---|---|---|
| 9 | NTTYVSNTT | 0.001 |
| 15 | NTTYVSNAT | 0.001 |
| 25 | SPQPSIFIC | 0.001 |
| 17 | TYVSNATGS | 0.001 |
| 33 | CSKEQELSY | 0.000 |
| 39 | LSYRNRNML | 0.000 |
| 51 | FIQKSTSCN | 0.000 |
| 14 | SNTTYVSNA | 0.000 |
| 7 | VINTTYVSN | 0.000 |
| 1 | VIHGVDVIN | 0.000 |
| 29 | SIFICSKEQ | 0.000 |
| 35 | KEQELSYRN | 0.000 |
| 30 | IFICSKEQE | 0.000 |
| 5 | VDVINTTYV | 0.000 |
| 47 | LAEDFIQKS | 0.000 |
| 43 | NRNMLAEDF | 0.000 |
| 32 | ICSKEQELS | 0.000 |
| 23 | TGSPQPSIF | 0.000 |
| 53 | QKSTSCNYV | 0.000 |
| 21 | NATGSPQPS | 0.000 |
| 62 | EKSSTFFKI | 0.000 |
| 26 | PQPSIFICS | 0.000 |
| 42 | RNRNMLAED | 0.000 |
| 54 | KSTSCNYVE | 0.000 |
| 38 | ELSYRNRNM | 0.000 |
| 57 | SCNYVEKSS | 0.000 |
| 37 | QELSYRNRN | 0.000 |
| 50 | DFIQKSTSC | 0.000 |
| 58 | CNYVEKSST | 0.000 |
| 20 | SNATGSPQP | 0.000 |
| 2 | IHGVDVINT | 0.000 |
| 8 | INTTYVSNT | 0.000 |
| 41 | YRNRNMLAE | 0.000 |
| 3 | HGVDVINTT | 0.000 |
| 48 | AEDFIQKST | 0.000 |
| 13 | VSNTTYVSN | 0.000 |
| 19 | VSNATGSPQ | 0.000 |
| 56 | TSCNYVEKS | 0.000 |
| 49 | EDFIQKSTS | 0.000 |
| 28 | PSIFICSKE | 0.000 |
| | V4-HLA-A1101-9mers-282P1G3 Each peptide is a portion of SEQ ID NO: 9; each start position is specified, the length of peptide is 9 amino acids, and the end position for each peptide is the start position plus eight. | |
| 9 | LPEQPTFLK | 0.600 |
| 1 | VTLYSGEDL | 0.015 |
| 8 | DLPEQPTFL | 0.001 |
| 3 | LYSGEDLPE | 0.001 |
| 2 | TLYSGEDLP | 0.001 |
| 6 | GEDLPEQPT | 0.000 |
| 7 | EDLPEQPTF | 0.000 |
| 4 | YSGEDLPEQ | 0.000 |
| 5 | SGEDLPEQP | 0.000 |
| | V5-HLA-A1101-9mers-282P1G3 Each peptide is a portion of SEQ ID NO: 11; each start position is specified, the length of peptide is 9 amino acids, and the end position for each peptide is the start position plus eight. | |
| 5 | TVNSSNSIK | 2.000 |
| 8 | SSNSIKQRK | 0.020 |
| 4 | LTVNSSNSI | 0.015 |
| 7 | NSSNSIKQR | 0.002 |
| 3 | KLTVNSSNS | 0.001 |
| 6 | VNSSNSIKQ | 0.000 |
| 1 | PMKLTVNSS | 0.000 |
| 2 | MKLTVNSSN | 0.000 |

TABLE XIV-continued

| Start | Subsequence | Score |
|---|---|---|
| 9 | SNSIKQRKP | 0.000 |
| | V6-HLA-A1101-9mers-282P1G3 Each peptide is a portion of SEQ ID NO: 13; each start position is specified, the length of peptide is 9 amino acids, and the end position for each peptide is the start position plus eight. | |
| 1 | EEIEFIVPK | 0.027 |
| 5 | FIVPKLEHI | 0.006 |
| 6 | IVPKLEHIE | 0.002 |
| 4 | EFIVPKLEH | 0.002 |
| 9 | KLEHIEQDE | 0.001 |
| 2 | EIEFIVPKL | 0.001 |
| 7 | VPKLEHIEQ | 0.000 |
| 3 | IEFIVPKLE | 0.000 |
| 8 | PKLEHIEQD | 0.000 |
| | V7-HLA-A1101-9mers-282P1G3 Each peptide is a portion of SEQ ID NO: 15; each start position is specified, the length of peptide is 9 amino acids, and the end position for each peptide is the start position plus eight. | |
| 19 | HPEPPRWTK | 0.400 |
| 16 | FTLHPEPPR | 0.300 |
| 5 | VIVEDNISH | 0.012 |
| 10 | NISHELFTL | 0.012 |
| 20 | PEPPRWTKK | 0.006 |
| 17 | TLHPEPPRW | 0.004 |
| 4 | HVIVEDNIS | 0.003 |
| 6 | IVEDNISHE | 0.002 |
| 7 | VEDNISHEL | 0.001 |
| 3 | FHVIVEDNI | 0.000 |
| 14 | ELFTLHPEP | 0.000 |
| 11 | ISHELFTLH | 0.000 |
| 15 | LFTLHPEPP | 0.000 |
| 13 | HELFTLHPE | 0.000 |
| 2 | DFHVIVEDN | 0.000 |
| 8 | EDNISHELF | 0.000 |
| 1 | HDFHVIVED | 0.000 |
| 12 | SHELFTLHP | 0.000 |
| 9 | DNISHELFT | 0.000 |
| 18 | LHPEPPRWT | 0.000 |

TABLE XV

| Start | Subsequence | Score |
|---|---|---|
| | V1-HLA-A1101-10mers-282P1G3 Each peptide is a portion of SEQ ID NO: 3; each start position is specified, the length of peptide is 10 amino acids, and the end position for each peptide is the start position plus nine. | |
| 930 | GVPEQPTFLK | 18.000 |
| 11 | IVYLMFLLLK | 8.000 |
| 212 | RTIVQKMPMK | 4.500 |
| 342 | IVEEPPRWTK | 4.000 |
| 126 | IVPSVPKLPK | 4.000 |
| 30 | SVQQVPTIIK | 4.000 |
| 14 | LMFLLLKFSK | 2.400 |
| 33 | QVPTIIKQSK | 2.000 |
| 1111 | LLLLTVCFVK | 1.800 |

TABLE XV-continued

| Start | Subsequence | Score |
|---|---|---|
| 701 | RVIAVNEVGR | 1.800 |
| 948 | ATLSWGLPKK | 1.500 |
| 1037 | KISGVNLTQK | 1.200 |
| 312 | KIENVSYQDK | 1.200 |
| 509 | SCWVENAIGK | 0.800 |
| 1010 | RACTSQGCGK | 0.600 |
| 870 | SLLDGRTHPK | 0.600 |
| 860 | GYQINWWKTK | 0.600 |
| 546 | HMLELHCESK | 0.600 |
| 1001 | ATTKYKFYLR | 0.400 |
| 995 | HLSNLNATTK | 0.400 |
| 733 | NIRVQASQPK | 0.400 |
| 848 | TVPKDRVHGR | 0.400 |
| 947 | TATLSWGLPK | 0.400 |
| 283 | LPTPQVDWNK | 0.400 |
| 466 | SPEAVVSWQK | 0.400 |
| 905 | HLTVLAYNSK | 0.400 |
| 62 | NPEPTFSWTK | 0.400 |
| 688 | VILPLAPFVR | 0.360 |
| 1196 | SFIGAYAGSK | 0.300 |
| 936 | TFLKVIKVDK | 0.300 |
| 1117 | CFVKRNRGGK | 0.300 |
| 51 | EYFQIECEAK | 0.240 |
| 532 | KLRVSPKNPR | 0.240 |
| 187 | DLYFANVEEK | 0.240 |
| 1136 | HPDPEIQSVK | 0.200 |
| 208 | FPRLRTIVQK | 0.200 |
| 529 | NATKLRVSPK | 0.200 |
| 844 | VTWSTVPKDR | 0.200 |
| 933 | EQPTFLKVIK | 0.180 |
| 660 | EYIVEFEGNK | 0.180 |
| 743 | EMIIKWEPLK | 0.180 |
| 1073 | SIFQDVIETR | 0.160 |
| 1121 | RNRGGKYSVK | 0.120 |
| 105 | GKYRCFASNK | 0.120 |
| 561 | KHSLKLSWSK | 0.120 |
| 300 | GRETKENYGK | 0.120 |
| 261 | GSESSITILK | 0.120 |
| 123 | IEFIVPSVPK | 0.120 |
| 292 | KIGGDLPKGR | 0.120 |
| 238 | EIGSKANSIK | 0.120 |
| 1112 | LLLTVCFVKR | 0.120 |
| 1057 | AEHIVRLMTK | 0.120 |
| 179 | RVYMSQKGDL | 0.120 |
| 295 | GDLPKGRETK | 0.090 |
| 451 | TVVGYSAFLH | 0.090 |
| 939 | KVIKVDKDTA | 0.090 |
| 290 | WNKIGGDLPK | 0.080 |
| 633 | NLHLSERQNR | 0.080 |
| 201 | DYCCFAAFPR | 0.072 |
| 523 | ANLDIRNATK | 0.060 |
| 834 | VDVINSTLVK | 0.060 |
| 148 | PIVLPCNPPK | 0.060 |
| 519 | TAVTANLDIR | 0.060 |
| 680 | RVQGKKTTVI | 0.060 |
| 552 | CESKCDSHLK | 0.060 |
| 370 | AEGEPQPTIK | 0.060 |
| 381 | RVNGSPVDNH | 0.060 |
| 833 | GVDVINSTLV | 0.060 |
| 518 | KTAVTANLDI | 0.060 |
| 343 | VEEPPRWTKK | 0.060 |
| 90 | GTFRIPNEGH | 0.060 |
| 675 | WEELTRVQGK | 0.060 |
| 9 | GLIVYLMFLL | 0.054 |
| 309 | KTLKIENVSY | 0.045 |
| 692 | LAPFVRYQFR | 0.040 |
| 99 | HISHFQGKYR | 0.040 |
| 535 | VSPKNPRIPK | 0.040 |
| 858 | LKGYQINWWK | 0.040 |
| 738 | ASQPKEMIIK | 0.040 |
| 471 | VSWQKVEEVK | 0.040 |
| 356 | AVYSTGSNGI | 0.040 |
| 429 | NANIDVVDVR | 0.040 |
| 219 | PMKLTVNSLK | 0.040 |
| 84 | IPSNNSGTFR | 0.040 |
| 792 | AVYAPYDVKV | 0.040 |
| 1028 | LGEGSKGIGK | 0.040 |

TABLE XV-continued

| Start | Subsequence | Score |
|---|---|---|
| 190 | FANVEEKDSR | 0.040 |
| 726 | APDRNPQNIR | 0.040 |
| 413 | AVYQCEASNV | 0.040 |
| 639 | RQNRSVRLTW | 0.036 |
| 755 | EQNGPGLEYR | 0.036 |
| 842 | VKVTWSTVPK | 0.030 |
| 435 | VDVRPLIQTK | 0.030 |
| 982 | NDINITTPSK | 0.030 |
| 791 | PAVYAPYDVK | 0.030 |
| 997 | SNLNATTKYK | 0.030 |
| 1123 | RGGKYSVKEK | 0.030 |
| 340 | HVIVEEPPRW | 0.030 |
| 735 | RVQASQPKEM | 0.030 |
| 499 | RTTEEDAGSY | 0.030 |
| | V2-HLA-A1101-10mers-(SET 1)-282P1G3 Each peptide is a portion of SEQ ID NO: 5; each start position is specified, the length of peptide is 10 amino acids, and the end position for each peptide is the start position plus nine. | |
| 3 | IVPSVPKFPK | 6.000 |
| 6 | SVPKFPKEKI | 0.020 |
| 9 | KFPKEKIDPL | 0.006 |
| 5 | PSVPKFPKEK | 0.002 |
| 1 | EFIVPSVPKF | 0.001 |
| 2 | FIVPSVPKFP | 0.000 |
| 10 | FPKEKIDPLE | 0.000 |
| 4 | VPSVPKFPKE | 0.000 |
| 7 | VPKFPKEKID | 0.000 |
| 8 | PKFPKEKIDP | 0.000 |
| | V2-HLA-A1101-10mers-(SET 2)-282P1G3 Each peptide is a portion of SEQ ID NO: 5; each start position is specified, the length of peptide is 10 amino acids, and the end position for each peptide is the start position plus nine. | |
| 4 | TLGEGKYAGL | 0.004 |
| 3 | STLGEGKYAG | 0.003 |
| 8 | GKYAGLYDDI | 0.001 |
| 6 | GEGKYAGLYD | 0.000 |
| 5 | LGEGKYAGLY | 0.000 |
| 2 | SSTLGEGKYA | 0.000 |
| 1 | ESSTLGEGKY | 0.000 |
| 7 | EGKYAGLYDD | 0.000 |
| | V2-HLA-A1101-10mers-(SET 3)-282P1G3 Each peptide is a portion of SEQ ID NO: 5; each start position is specified, the length of peptide is 10 amino acids, and the end position for each peptide is the start position plus nine. | |
| 1 | EESSTLGEGK | 0.018 |
| 5 | TLGEGKYAGL | 0.004 |
| 4 | STLGEGKYAG | 0.003 |
| 9 | GKYAGLYDDI | 0.001 |
| 10 | KYAGLYDDIS | 0.001 |
| 7 | GEGKYAGLYD | 0.000 |
| 6 | LGEGKYAGLY | 0.000 |
| 3 | SSTLGEGKYA | 0.000 |
| 2 | ESSTLGEGKY | 0.000 |
| 8 | EGKYAGLYDD | 0.000 |
| | V3-HLA-A1101-10mers-282P1G3 Each peptide is a portion of SEQ ID NO: 7; each start position is specified, the length of peptide is 10 amino acids, and the end position for each peptide is the start position plus nine. | |

TABLE XV-continued

| Start | Subsequence | Score |
|---|---|---|
| 61 | YVEKSSTFFK | 6.000 |
| 46 | NMLAEDFIQK | 1.200 |
| 55 | KSTSCNYVEK | 0.060 |
| 27 | PQPSIFICSK | 0.060 |
| 5 | GVDVINTTYV | 0.060 |
| 11 | TTYVSNTTYV | 0.020 |
| 10 | NTTYVSNTTY | 0.010 |
| 23 | ATGSPQPSIF | 0.010 |
| 60 | NYVEKSSTFF | 0.006 |
| 53 | IQKSTSCNYV | 0.006 |
| 33 | ICSKEQELSY | 0.004 |
| 34 | CSKEQELSYR | 0.004 |
| 52 | FIQKSTSCNY | 0.004 |
| 36 | KEQELSYRNR | 0.004 |
| 31 | IFICSKEQEL | 0.003 |
| 22 | NATGSPQPSI | 0.002 |
| 17 | TTYVSNATGS | 0.002 |
| 19 | YVSNATGSPQ | 0.002 |
| 13 | YVSNTTYVSN | 0.002 |
| 62 | VEKSSTFFKI | 0.002 |
| 12 | TYVSNTTYVS | 0.001 |
| 43 | RNRNMLAEDF | 0.001 |
| 39 | ELSYRNRNML | 0.001 |
| 56 | STSCNYVEKS | 0.001 |
| 16 | NTTYVSNATG | 0.001 |
| 7 | DVINTTYVSN | 0.001 |
| 30 | SIFICSKEQE | 0.001 |
| 41 | SYRNRNMLAE | 0.001 |
| 2 | VIHGVDVINT | 0.001 |
| 59 | CNYVEKSSTF | 0.001 |
| 40 | LSYRNRNMLA | 0.001 |
| 45 | RNMLAEDFIQ | 0.001 |
| 18 | TYVSNATGSP | 0.001 |
| 47 | MLAEDFIQKS | 0.000 |
| 24 | TGSPQPSIFI | 0.000 |
| 8 | VINTTYVSNT | 0.000 |
| 32 | FICSKEQELS | 0.000 |
| 26 | SPQPSIFICS | 0.000 |
| 4 | HGVDVINTTY | 0.000 |
| 1 | PVIHGVDVIN | 0.000 |
| 44 | NRNMLAEDFI | 0.000 |
| 28 | QPSIFICSKE | 0.000 |
| 58 | SCNYVEKSST | 0.000 |
| 14 | VSNTTYVSNA | 0.000 |
| 25 | GSPQPSIFIC | 0.000 |
| 37 | EQELSYRNRN | 0.000 |
| 48 | LAEDFIQKST | 0.000 |
| 51 | DFIQKSTSCN | 0.000 |
| 38 | QELSYRNRNM | 0.000 |
| 6 | VDVINTTYVS | 0.000 |
| 49 | AEDFIQKSTS | 0.000 |
| 54 | QKSTSCNYVE | 0.000 |
| 9 | INTTYVSNTT | 0.000 |
| 21 | SNATGSPQPS | 0.000 |
| 35 | SKEQELSYRN | 0.000 |
| 15 | SNTTYVSNAT | 0.000 |
| 20 | VSNATGSPQP | 0.000 |
| 3 | IHGVDVINTT | 0.000 |
| 42 | YRNRNMLAED | 0.000 |
| 50 | EDFIQKSTSC | 0.000 |
| 57 | TSCNYVEKSS | 0.000 |
| 29 | PSIFICSKEQ | 0.000 |
| | V4-HLA-A1101-10mers-282P1G3 Each peptide is a portion of SEQ ID NO: 9; each start position is specified, the length of peptide is 10 amino acids, and the end position for each peptide is the start position plus nine. | |
| 9 | DLPEQPTFLK | 0.360 |
| 1 | SVTLYSGEDL | 0.020 |

TABLE XV-continued

| Start | Subsequence | Score |
|---|---|---|
| 10 | LPEQPTFLKV | 0.004 |
| 7 | GEDLPEQPTF | 0.002 |
| 3 | TLYSGEDLPE | 0.002 |
| 2 | VTLYSGEDLP | 0.002 |
| 4 | LYSGEDLPEQ | 0.000 |
| 8 | EDLPEQPTFL | 0.000 |
| 6 | SGEDLPEQPT | 0.000 |
| 5 | YSGEDLPEQP | 0.000 |

V5-HLA-A1101-10mers-282P1G3 Each peptide is a portion of SEQ ID NO: 11; each start position is specified, the length of peptide is 10 amino acids, and the end position for each peptide is the start position plus nine.

| Start | Subsequence | Score |
|---|---|---|
| 5 | LTVNSSNSIK | 1.500 |
| 8 | NSSNSIKQRK | 0.020 |
| 10 | SNSIKQRKPK | 0.020 |
| 4 | KLTVNSSNSI | 0.012 |
| 6 | TVNSSNSIKQ | 0.004 |
| 7 | VNSSNSIKQR | 0.004 |
| 1 | MPMKLTVNSS | 0.000 |
| 2 | PMKLTVNSSN | 0.000 |
| 3 | MKLTVNSSNS | 0.000 |
| 9 | SSNSIKQRKP | 0.000 |

V6-HLA-A1101-10mers-282P1G3 Each peptide is a portion of SEQ ID NO: 13; each start position is specified, the length of peptide is 10 amino acids, and the end position for each peptide is the start position plus nine.

| Start | Subsequence | Score |
|---|---|---|
| 10 | KLEHIEQDER | 0.240 |
| 1 | SEEIEFIVPK | 0.060 |
| 7 | IVPKLEHIEQ | 0.004 |
| 4 | IEFIVPKLEH | 0.002 |
| 5 | EFIVPKLEHI | 0.001 |
| 6 | FIVPKLEHIE | 0.001 |
| 2 | EEIEFIVPKL | 0.000 |
| 8 | VPKLEHIEQD | 0.000 |
| 3 | EIEFIVPKLE | 0.000 |
| 9 | PKLEHIEQDE | 0.000 |

V7-HLA-A1101-10mers-282P1G3 Each peptide is a portion of SEQ ID NO: 15; each start position is specified, the length of peptide is 10 amino acids, and the end position for each peptide is the start position plus nine.

| Start | Subsequence | Score |
|---|---|---|
| 20 | HPEPPRWTKK | 0.200 |
| 5 | HVIVEDNISH | 0.060 |
| 16 | LFTLHPEPPR | 0.040 |
| 19 | LHPEPPRWTK | 0.040 |
| 7 | IVEDNISHEL | 0.020 |
| 17 | FTLHPEPPRW | 0.015 |
| 11 | NISHELFTLH | 0.004 |
| 6 | VIVEDNISHE | 0.001 |
| 8 | VEDNISHELF | 0.001 |
| 3 | DFHVIVEDNI | 0.001 |
| 10 | DNISHELFTL | 0.001 |
| 15 | ELFTLHPEPP | 0.000 |
| 14 | HELFTLHPEP | 0.000 |
| 18 | TLHPEPPRWT | 0.000 |
| 12 | ISHELFTLHP | 0.000 |
| 2 | HDFHVIVEDN | 0.000 |
| 4 | FHVIVEDNIS | 0.000 |
| 13 | SHELFTLHPE | 0.000 |
| 1 | THDFHVIVED | 0.000 |
| 9 | EDNISHELFT | 0.000 |
| 21 | PEPPRWTKKP | 0.000 |

TABLE XVI

V1-HLA-A24-9mers-282P1G3 Each peptide is a portion of SEQ ID NO: 3; each start position is specified, the length of peptide is 9 amino acids, and the end position for each peptide is the start position plus eight.

| Start | Subsequence | Score |
|---|---|---|
| 180 | VYMSQKGDL | 300.000 |
| 1182 | EYGEGDHGL | 240.000 |
| 323 | NYRCTASNF | 100.000 |
| 823 | DYPDTAPVI | 90.000 |
| 964 | GYLLQYQII | 90.000 |
| 489 | IYENGTLQI | 75.000 |
| 1085 | EYAGLYDDI | 60.000 |
| 357 | VYSTGSNGI | 60.000 |
| 76 | FYFTDHRII | 50.000 |
| 102 | HFQGKYRCF | 15.000 |
| 697 | RYQFRVIAV | 15.000 |
| 584 | RIIIDGANL | 12.000 |
| 486 | RYHIYENGT | 12.000 |
| 968 | QYQIINDTY | 10.500 |
| 1004 | KYKFYLRAC | 10.000 |
| 1052 | VFEPGAEHI | 9.000 |
| 1098 | WFIGLMCAI | 9.000 |
| 660 | EYIVEFEGN | 9.000 |
| 8 | RGLIVYLMF | 8.400 |
| 289 | DWNKIGGDL | 8.400 |
| 860 | GYQINWWKT | 8.250 |
| 991 | KPSWHLSNL | 8.000 |
| 942 | KVDKDTATL | 8.000 |
| 247 | KQRKPKLLL | 8.000 |
| 890 | RNSGMVPSL | 8.000 |
| 125 | FIVPSVPKL | 7.920 |
| 51 | EYFQIECEA | 7.700 |
| 414 | VVQCEASNV | 7.500 |
| 10 | LIVYLMFLL | 7.200 |
| 2 | EPLLLGRGL | 7.200 |
| 1094 | STQGWFIGL | 7.200 |
| 1104 | CAIALLTLL | 7.200 |
| 626 | DVPDPPENL | 7.200 |
| 930 | GVPEQPTFL | 7.200 |
| 448 | NYATVVGYS | 7.000 |
| 793 | VYAPYDVKV | 6.600 |
| 214 | IVQKMPMKL | 6.600 |
| 1100 | IGLMCAIAL | 6.000 |
| 451 | TVVGYSAFL | 6.000 |
| 1101 | GLMCAIALL | 6.000 |
| 1190 | LFSEDGSFI | 6.000 |
| 9 | GLIVYLMFL | 6.000 |
| 154 | NPPKGLPPL | 6.000 |
| 796 | PYDVKVQAI | 6.000 |
| 419 | ASNVHGTIL | 6.000 |
| 959 | NGNLTGYLL | 6.000 |
| 275 | LLECFAEGL | 6.000 |
| 261 | GSESSITIL | 6.000 |
| 267 | TILKGEILL | 6.000 |
| 753 | SMEQNGPGL | 6.000 |
| 901 | FSEFHLTVL | 6.000 |
| 743 | EMIIKWEPL | 6.000 |
| 266 | ITILKGEIL | 6.000 |
| 1127 | YSVKEKEDL | 6.000 |
| 1106 | IALLTLLLL | 6.000 |
| 833 | GVDVINSTL | 5.600 |
| 39 | KQSKVQVAF | 5.600 |
| 950 | LSWGLPKKL | 5.280 |

TABLE XVI-continued

| Start | Subsequence | Score |
|---|---|---|
| 507 | SYSCWVENA | 5.000 |
| 109 | CFASNKLGI | 5.000 |
| 604 | IYCCSAHTA | 5.000 |
| 1172 | QPTESADSL | 4.800 |
| 946 | DTATLSWGL | 4.800 |
| 958 | LNGNLTGYL | 4.800 |
| 133 | LPKEKIDPL | 4.800 |
| 11 | IVYLMFLLL | 4.800 |
| 203 | CCFAAFPRL | 4.800 |
| 6 | LGRGLIVYL | 4.800 |
| 810 | GPDPQSVTL | 4.800 |
| 1105 | AIALLTLLL | 4.800 |
| 954 | LPKKLNGNL | 4.800 |
| 245 | SIKQRKPKL | 4.400 |
| 163 | HIYWMNIEL | 4.400 |
| 542 | IPKLHMLEL | 4.400 |
| 692 | LAPFVRYQF | 4.200 |
| 359 | STGSNGILL | 4.000 |
| 358 | YSTGSNGIL | 4.000 |
| 1103 | MCAIALLTL | 4.000 |
| 1152 | YSDSDEKPL | 4.000 |
| 1001 | ATTKYKFYL | 4.000 |
| 864 | NWWKTKSLL | 4.000 |
| 151 | LPCNPPKGL | 4.000 |
| 1035 | IGKISGVNL | 4.000 |
| 591 | NLTISNVTL | 4.000 |
| 682 | QGKKTTVIL | 4.000 |
| 1214 | GSSTATFPL | 4.000 |
| 863 | INWWKTKSL | 4.000 |
| 268 | ILKGEILLL | 4.000 |
| 605 | YCCSAHTAL | 4.000 |
| 988 | TPSKPSWHL | 4.000 |
| 13 | YLMFLLLKF | 3.960 |
| 893 | GMVPSLDAF | 3.600 |
| 1110 | TLLLLTVCF | 3.600 |
| 929 | EGVPEQPTF | 3.600 |
| 117 | IAMSEEIEF | 3.300 |
| 384 | GSPVDNHPF | 3.000 |
| 1183 | YGEGDHGLF | 3.000 |
| 450 | ATVVGYSAF | 3.000 |
| 687 | TVILPLAPF | 3.000 |
| 917 | GPESEPYIF | 3.000 |
| | V2-HLA-A24-9mers-(SET 1)-282P1G3 Each peptide is a portion of SEQ ID NO: 5; each start position is specified, the length of peptide is 9 amino acids, and the end position for each peptide is the start position plus eight. | |
| 9 | FPKEKIDPL | 4.800 |
| 1 | FIVPSVPKF | 3.960 |
| 6 | VPKFPKEKI | 1.100 |
| 8 | KFPKEKIDP | 0.150 |
| 2 | IVPSVPKFP | 0.021 |
| 5 | SVPKFPKEK | 0.017 |
| 3 | VPSVPKFPK | 0.010 |
| 4 | PSVPKFPKE | 0.002 |
| 7 | PKFPKEKID | 0.000 |
| | V2-HLA-A24-9mers-(SET 2)-282P1G3 Each peptide is a portion of SEQ ID NO: 5; each start position is specified, the length of peptide is 9 amino acids, and the end position for each peptide is the start position plus eight. | |
| 9 | AKENYGKTL | 0.600 |
| 5 | KGREAKENY | 0.240 |
| 8 | EAKENYGKT | 0.132 |
| 1 | GDLPKGREA | 0.020 |
| 2 | DLPKGREAK | 0.015 |
| 3 | LPKGREAKE | 0.011 |

TABLE XVI-continued

| Start | Subsequence | Score |
|---|---|---|
| 7 | REAKENYGK | 0.002 |
| 6 | GREAKENYG | 0.002 |
| 4 | PKGREAKEN | 0.001 |
| | V2-HLA-A24-9mers-(SET 3)-282P1G3 Each peptide is a portion of SEQ ID NO: 5; each start position is specified, the length of peptide is 9 amino acids, and the end position for each peptide is the start position plus eight. | |
| 9 | KYAGLYDDI | 120.000 |
| 5 | LGEGKYAGL | 6.000 |
| 3 | STLGEGKYA | 0.150 |
| 2 | SSTLGEGKY | 0.110 |
| 1 | ESSTLGEGK | 0.012 |
| 4 | TLGEGKYAG | 0.012 |
| 6 | GEGKYAGLY | 0.010 |
| 7 | EGKYAGLYD | 0.010 |
| 8 | GKYAGLYDD | 0.001 |
| | V3-HLA-A24-9mers-282P1G3 Each peptide is a portion of SEQ ID NO: 7; each start position is specified, the length of peptide is 9 amino acids, and the end position for each peptide is the start position plus eight. | |
| 59 | NYVEKSSTF | 180.000 |
| 17 | TYVSNATGS | 7.500 |
| 11 | TYVSNTTYV | 7.500 |
| 31 | FICSKEQEL | 5.280 |
| 40 | SYRNRNMLA | 5.000 |
| 39 | LSYRNRNML | 4.800 |
| 60 | YVEKSSTFF | 3.000 |
| 44 | RNMLAEDFI | 3.000 |
| 23 | TGSPQPSIF | 2.400 |
| 24 | GSPQPSIFI | 1.500 |
| 22 | ATGSPQPSI | 1.000 |
| 50 | DFIQKSTSC | 0.750 |
| 38 | ELSYRNRNM | 0.500 |
| 43 | NRNMLAEDF | 0.360 |
| 3 | HGVDVINTT | 0.302 |
| 47 | LAEDFIQKS | 0.238 |
| 57 | SCNYVEKSS | 0.210 |
| 25 | SPQPSIFIC | 0.180 |
| 15 | NTTYVSNAT | 0.168 |
| 9 | NTTYVSNTT | 0.168 |
| 51 | FIQKSTSCN | 0.150 |
| 13 | VSNTTYVSN | 0.150 |
| 6 | DVINTTYVS | 0.150 |
| 7 | VINTTYVSN | 0.150 |
| 1 | VIHGVDVIN | 0.140 |
| 4 | GVDVINTTY | 0.140 |
| 62 | EKSSTFFKI | 0.132 |
| 33 | CSKEQELSY | 0.120 |
| 21 | NATGSPQPS | 0.120 |
| 56 | TSCNYVEKS | 0.110 |
| 10 | TTYVSNTTY | 0.100 |
| 14 | SNTTYVSNA | 0.100 |
| 32 | ICSKEQELS | 0.100 |
| 8 | INTTYVSNT | 0.100 |
| 12 | YVSNTTYVS | 0.100 |
| 52 | IQKSTSCNY | 0.100 |
| 58 | CNYVEKSST | 0.100 |
| 30 | IFICSKEQE | 0.075 |
| 35 | KEQELSYRN | 0.043 |
| 26 | PQPSIFICS | 0.025 |
| 42 | RNRNMLAED | 0.022 |
| 54 | KSTSCNYVE | 0.020 |
| 37 | QELSYRNRN | 0.018 |
| 19 | VSNATGSPQ | 0.015 |
| 36 | EQELSYRNR | 0.015 |

TABLE XVI-continued

| Start | Subsequence | Score |
|---|---|---|
| 45 | NMLAEDFIQ | 0.015 |
| 5 | VDVINTTYV | 0.015 |
| 46 | MLAEDFIQK | 0.014 |
| 48 | AEDFIQKST | 0.014 |
| 53 | QKSTSCNYV | 0.012 |
| 55 | STSCNYVEK | 0.011 |
| 29 | SIFICSKEQ | 0.011 |
| 2 | IHGVDVINT | 0.010 |
| 16 | TTYVSNATG | 0.010 |
| 20 | SNATGSPQP | 0.010 |
| 27 | QPSIFICSK | 0.010 |
| 18 | YVSNATGSP | 0.010 |
| 49 | EDFIQKSTS | 0.010 |
| 28 | PSIFICSKE | 0.002 |
| 34 | SKEQELSYR | 0.002 |
| 41 | YRNRNMLAE | 0.002 |
| 61 | VEKSSTFFK | 0.001 |
| | V4-HLA-A24-9mers-282P1G3 Each peptide is a portion of SEQ ID NO: 9; each start position is specified, the length of peptide is 9 amino acids, and the end position for each peptide is the start position plus eight. | |
| 8 | DLPEQPTFL | 7.200 |
| 1 | VTLYSGEDL | 6.000 |
| 3 | LYSGEDLPE | 0.500 |
| 7 | EDLPEQPTF | 0.360 |
| 5 | SGEDLPEQP | 0.022 |
| 9 | LPEQPTFLK | 0.015 |
| 4 | YSGEDLPEQ | 0.013 |
| 6 | GEDLPEQPT | 0.012 |
| 2 | TLYSGEDLP | 0.010 |
| | V5-HLA-A24-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 1.800 |
| 3 | KLTVNSSNS | 0.200 |
| 8 | SSNSIKQRK | 0.025 |
| 2 | MKLTVNSSN | 0.021 |
| 5 | TVNSSNSIK | 0.015 |
| 1 | PMKLTVNSS | 0.012 |
| 6 | VNSSNSIKQ | 0.011 |
| 9 | SNSIKQRKP | 0.011 |
| 7 | NSSNSIKQR | 0.010 |
| | V6-HLA-A24-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 9.240 |
| 5 | FIVPKLEHI | 1.800 |
| 4 | EFIVPKLEH | 0.083 |
| 9 | KLEHIEQDE | 0.050 |
| 6 | IVPKLEHIE | 0.018 |
| 7 | VPKLEHIEQ | 0.011 |
| 1 | EEIEFIVPK | 0.002 |
| 3 | IEFIVPKLE | 0.001 |
| 8 | PKLEHIEQD | 0.000 |
| | V7-HLA-A24-9mers-282P1G3 Each peptide is a portion of | |

TABLE XVI-continued

| Start | Subsequence | Score |
|---|---|---|
| | SEQ ID NO: 15; each start position is specified, the length of peptide is 9 amino acids, and the end position for each peptide is the start position plus eight. | |
| 10 | NISHELFTL | 4.000 |
| 2 | DFHVIVEDN | 0.700 |
| 7 | VEDNISHEL | 0.616 |
| 8 | EDNISHELF | 0.300 |
| 3 | FHVIVEDNI | 0.210 |
| 4 | HVIVEDNIS | 0.180 |
| 9 | DNISHELFT | 0.150 |
| 17 | TLHPEPPRW | 0.120 |
| 15 | LFTLHPEPP | 0.050 |
| 18 | LHPEPPRWT | 0.018 |
| 6 | IVEDNISHE | 0.018 |
| 5 | VIVEDNISH | 0.018 |
| 19 | HPEPPRWTK | 0.018 |
| 11 | ISHELFTLH | 0.017 |
| 16 | FTLHPEPPR | 0.015 |
| 14 | ELFTLHPEP | 0.013 |
| 1 | HDFHVIVED | 0.002 |
| 13 | HELFTLHPE | 0.002 |
| 12 | SHELFTLHP | 0.002 |
| 20 | PEPPRWTKK | 0.000 |

TABLE XVII

| Start | Subsequence | Score |
|---|---|---|
| | V1-HLA-A24-10mers-282P1G3 Each peptide is a portion of SEQ ID NO: 3; each start position is specified, the length of peptide is 10 amino acids, and the end position for each peptide is the start position plus nine. | |
| 106 | KYRCFASNKL | 528.000 |
| 1126 | KYSVKEKEDL | 400.000 |
| 486 | RYHIYENGTL | 400.000 |
| 323 | NYRCTASNFL | 240.000 |
| 1151 | EYSDSDEKPL | 240.000 |
| 357 | VYSTGSNGIL | 200.000 |
| 604 | IYCCSAHTAL | 200.000 |
| 12 | VYLMFLLLKF | 198.000 |
| 454 | GYSAFLHCEF | 132.000 |
| 1182 | EYGEGDHGLF | 120.000 |
| 975 | TYEIGELNDI | 90.000 |
| 507 | SYSCWVENAI | 84.000 |
| 124 | EFIVPSVPKL | 33.000 |
| 900 | AFSEFHLTVL | 24.000 |
| 697 | RYQFRVIAVN | 21.000 |
| 330 | NFLGTATHDF | 15.000 |
| 752 | KSMEQNGPGL | 14.400 |
| 957 | KLNGNLTGYL | 14.400 |
| 541 | RIPKLHMLEL | 13.200 |
| 1019 | KPITEESSTL | 12.000 |
| 1158 | KPLKGSLRSL | 12.000 |
| 132 | KLPKEKIDPL | 12.000 |
| 8 | RGLIVYLMFL | 12.000 |
| 1004 | KYKFYLRACT | 12.000 |
| 875 | RTHPKEVNIL | 11.520 |
| 832 | HGVDVINSTL | 10.080 |
| 555 | KCDSHLKHSL | 9.600 |
| 489 | IYENGTLQIN | 9.000 |
| 317 | SYQDKGNYRC | 9.000 |
| 179 | RVYMSQKGDL | 8.000 |
| 180 | VYMSQKGDLY | 7.500 |
| 964 | GYLLQYQIIN | 7.500 |
| 46 | AFPFDEYFQI | 7.500 |
| 1089 | LYDDISTQGW | 7.200 |
| 153 | CNPPKGLPPL | 7.200 |

TABLE XVII-continued

| Start | Subsequence | Score |
|---|---|---|
| 9 | GLIVYLMFLL | 7.200 |
| 929 | EGVPEQPTFL | 7.200 |
| 218 | MPMKLTVNSL | 7.200 |
| 953 | GLPKKLNGNL | 7.200 |
| 274 | LLLECFAEGL | 7.200 |
| 142 | EVEEGDPIVL | 7.200 |
| 10 | LIVYLMFLLL | 7.200 |
| 809 | SGPDPQSVTL | 7.200 |
| 270 | KGEILLLECF | 7.200 |
| 1104 | CAIALLTLLL | 7.200 |
| 448 | NYATVVGYSA | 7.000 |
| 849 | VPKDRVHGRL | 6.720 |
| 213 | TIVQKMPMKL | 6.600 |
| 306 | NYGKTLKIEN | 6.600 |
| 244 | NSIKQRKPKL | 6.600 |
| 1100 | IGLMCAIALL | 6.000 |
| 551 | HCESKCDSHL | 6.000 |
| 590 | ANLTISNVTL | 6.000 |
| 266 | ITILKGEILL | 6.000 |
| 267 | TILKGEILLL | 6.000 |
| 150 | VLPCNPPKGL | 6.000 |
| 987 | TTPSKPSWHL | 6.000 |
| 862 | QINWWKTKSL | 6.000 |
| 1171 | MQPTESADSL | 6.000 |
| 450 | ATVVGYSAFL | 6.000 |
| 398 | FPREISFTNL | 5.760 |
| 516 | IGKTAVTANL | 5.600 |
| 949 | TLSWGLPKKL | 5.280 |
| 1200 | AYAGSKEKGS | 5.000 |
| 818 | LYSGEDYPDT | 5.000 |
| 885 | RFSGQRNSGM | 5.000 |
| 91 | TFRIPNEGHI | 5.000 |
| 1085 | EYAGLYDDIS | 5.000 |
| 260 | SGSESSITIL | 4.800 |
| 798 | DVKVQAINQL | 4.800 |
| 627 | VPDPPENLHL | 4.800 |
| 1093 | ISTQGWFIGL | 4.800 |
| 302 | ETKENYGKTL | 4.800 |
| 202 | YCCFAAFPRL | 4.800 |
| 5 | LLGRGLIVYL | 4.800 |
| 1103 | MCAIALLTLL | 4.800 |
| 199 | RNDYCCFAAF | 4.800 |
| 536 | SPKNPRIPKL | 4.400 |
| 557 | DSHLKHSLKL | 4.400 |
| 972 | INDTYEIGEL | 4.400 |
| 524 | NLDIRNATKL | 4.400 |
| 681 | VQGKKTTVIL | 4.000 |
| 245 | SIKQRKPKLL | 4.000 |
| 539 | NPRIPKLHML | 4.000 |
| 1034 | GIGKISGVNL | 4.000 |
| 1105 | AIALLTLLLL | 4.000 |
| 431 | NIDVVDVRPL | 4.000 |
| 863 | INWWKTKSLL | 4.000 |
| 1099 | FIGLMCAIAL | 4.000 |
| 1102 | LMCAIALLTL | 4.000 |
| 1213 | NGSSTATFPL | 4.000 |
| 1054 | EPGAEHIVRL | 4.000 |
| 958 | LNGNLTGYLL | 4.000 |
| 897 | SLDAFSEFHL | 4.000 |
| 1066 | KNWGDNDSIF | 4.000 |
| 418 | EASNVHGTIL | 4.000 |
| 1000 | NATTKYKFYL | 4.000 |
| 358 | YSTGSNGILL | 4.000 |
| 1080 | ETRGREYAGL | 4.000 |
| 616 | AADITQVTVL | 4.000 |
| | V2-HLA-A24-10mers-(SET 1)-282P1G3 Each peptide is a portion of SEQ ID NO: 5; each start position is specified, the length of peptide is 10 amino acids, and the end position for each peptide is the start position plus nine. | |
| 9 | KFPKEKIDPL | 60.000 |
| 1 | EFIVPSVPKF | 16.500 |

TABLE XVII-continued

| Start | Subsequence | Score |
|---|---|---|
| 6 | SVPKFPKEKI | 1.650 |
| 2 | FIVPSVPKFP | 0.025 |
| 10 | FPKEKIDPLE | 0.017 |
| 3 | IVPSVPKFPK | 0.015 |
| 4 | VPSVPKFPKE | 0.013 |
| 7 | VPKFPKEKID | 0.010 |
| 5 | PSVPKFPKEK | 0.002 |
| 8 | PKFPKEKIDP | 0.000 |
| | V2-HLA-A24-10mers-(SET 2)-282P1G3 Each peptide is a portion of SEQ ID NO: 5; each start position is specified, the length of peptide is 10 amino acids, and the end position for each peptide is the start position plus nine. | |
| 4 | TLGEGKYAGL | 4.800 |
| 5 | LGEGKYAGLY | 0.150 |
| 8 | GKYAGLYDDI | 0.120 |
| 1 | ESSTLGEGKY | 0.110 |
| 2 | SSTLGEGKYA | 0.100 |
| 3 | STLGEGKYAG | 0.015 |
| 7 | EGKYAGLYDD | 0.010 |
| 6 | GEGKYAGLYD | 0.001 |
| | V2-HLA-A24-10mers-(SET 3)-282P1G3 Each peptide is a portion of SEQ ID NO: 5; each start position is specified, the length of peptide is 10 amino acids, and the end position for each peptide is the start position plus nine. | |
| 10 | KYAGLYDDIS | 10.000 |
| 5 | TLGEGKYAGL | 4.800 |
| 6 | LGEGKYAGLY | 0.150 |
| 9 | GKYAGLYDDI | 0.120 |
| 2 | ESSTLGEGKY | 0.110 |
| 3 | SSTLGEGKYA | 0.100 |
| 4 | STLGEGKYAG | 0.015 |
| 8 | EGKYAGLYDD | 0.010 |
| 1 | EESSTLGEGK | 0.001 |
| 7 | GEGKYAGLYD | 0.001 |
| | V3-HLA-A24-10mers-282P1G3 Each peptide is a portion of SEQ ID NO: 7; each start position is specified, the length of peptide is 10 amino acids, and the end position for each peptide is the start position plus nine. | |
| 60 | NYVEKSSTFF | 180.000 |
| 31 | IFICSKEQEL | 39.600 |
| 12 | TYVSNTTYVS | 7.500 |
| 43 | RNRNMLAEDF | 4.800 |
| 39 | ELSYRNRNML | 4.800 |
| 23 | ATGSPQPSIF | 2.000 |
| 59 | CNYVEKSSTF | 2.000 |
| 24 | TGSPQPSIFI | 1.200 |
| 22 | NATGSPQPSI | 1.000 |
| 51 | DFIQKSTSCN | 0.750 |
| 18 | TYVSNATGSP | 0.750 |
| 41 | SYRNRNMLAE | 0.500 |
| 26 | SPQPSIFICS | 0.302 |
| 4 | HGVDVINTTY | 0.252 |
| 48 | LAEDFIQKST | 0.252 |
| 37 | EQELSYRNRN | 0.180 |
| 15 | SNTTYVSNAT | 0.168 |
| 9 | INTTYVSNTT | 0.168 |
| 47 | MLAEDFIQKS | 0.158 |
| 25 | GSPQPSIFIC | 0.150 |
| 8 | VINTTYVSNT | 0.150 |

TABLE XVII-continued

| Start | Subsequence | Score |
|---|---|---|
| 14 | VSNTTYVSNA | 0.150 |
| 7 | DVINTTYVSN | 0.150 |
| 44 | NRNMLAEDFI | 0.150 |
| 52 | FIQKSTSCNY | 0.150 |
| 58 | SCNYVEKSST | 0.150 |
| 57 | TSCNYVEKSS | 0.140 |
| 62 | VEKSSTFFKI | 0.132 |
| 53 | IQKSTSCNYV | 0.120 |
| 21 | SNATGSPQPS | 0.120 |
| 56 | STSCNYVEKS | 0.110 |
| 17 | TTYVSNATGS | 0.100 |
| 10 | NTTYVSNTTY | 0.100 |
| 2 | VIHGVDVINT | 0.100 |
| 5 | GVDVINTTYV | 0.100 |
| 11 | TTYVSNTTYV | 0.100 |
| 32 | FICSKEQELS | 0.100 |
| 33 | ICSKEQELSY | 0.100 |
| 13 | YVSNTTYVSN | 0.100 |
| 40 | LSYRNRNMLA | 0.100 |
| 38 | QELSYRNRNM | 0.075 |
| 45 | RNMLAEDFIQ | 0.030 |
| 55 | KSTSCNYVEK | 0.022 |
| 1 | PVIHGVDVIN | 0.021 |
| 35 | SKEQELSYRN | 0.018 |
| 46 | NMLAEDFIQK | 0.018 |
| 3 | IHGVDVINTT | 0.017 |
| 28 | QPSIFICSKE | 0.015 |
| 20 | VSNATGSPQP | 0.015 |
| 6 | VDVINTTYVS | 0.015 |
| 61 | YVEKSSTFFK | 0.015 |
| 34 | CSKEQELSYR | 0.012 |
| 50 | EDFIQKSTSC | 0.010 |
| 49 | AEDFIQKSTS | 0.010 |
| 16 | NTTYVSNATG | 0.010 |
| 19 | YVSNATGSPQ | 0.010 |
| 30 | SIFICSKEQE | 0.010 |
| 36 | KEQELSYRNR | 0.004 |
| 29 | PSIFICSKEQ | 0.002 |
| 42 | YRNRNMLAED | 0.002 |
| 27 | PQPSIFICSK | 0.002 |
| 54 | QKSTSCNYVE | 0.001 |
| | V4-HLA-A24-10mers-282P1G3 Each peptide is a portion of SEQ ID NO: 9; each start position is specified, the length of peptide is 10 amino acids, and the end position for each peptide is the start position plus nine. | |
| 1 | SVTLYSGEDL | 4.000 |
| 8 | EDLPEQPTFL | 0.720 |
| 4 | LYSGEDLPEQ | 0.550 |
| 6 | SGEDLPEQPT | 0.216 |
| 7 | GEDLPEQPTF | 0.200 |
| 10 | LPEQPTFLKV | 0.198 |
| 9 | DLPEQPTFLK | 0.018 |
| 2 | VTLYSGEDLP | 0.015 |
| 5 | YSGEDLPEQP | 0.014 |
| 3 | TLYSGEDLPE | 0.010 |
| | V5-HLA-A24-10mers-282P1G3 Each peptide is a portion of SEQ ID NO: 11; each start position is specified, the length of peptide is 10 amino acids, and the end position for each peptide is the start position plus nine. | |
| 4 | KLTVNSSNSI | 2.400 |
| 1 | MPMKLTVNSS | 0.180 |
| 8 | NSSNSIKQRK | 0.017 |
| 6 | TVNSSNSIKQ | 0.017 |
| 9 | SSNSIKQRKP | 0.017 |
| 3 | MKLTVNSSNS | 0.015 |

TABLE XVII-continued

| Start | Subsequence | Score |
|---|---|---|
| 5 | LTVNSSNSIK | 0.015 |
| 2 | PMKLTVNSSN | 0.014 |
| 7 | VNSSNSIKQR | 0.010 |
| 10 | SNSIKQRKPK | 0.010 |
| | V6-HLA-A24-10mers-282P1G3 Each peptide is a portion of SEQ ID NO: 13; each start position is specified, the length of peptide is 10 amino acids, and the end position for each peptide is the start position plus nine. | |
| 5 | EFIVPKLEHI | 7.500 |
| 2 | EEIEFIVPKL | 1.109 |
| 10 | KLEHIEQDER | 0.033 |
| 6 | FIVPKLEHIE | 0.022 |
| 3 | EIEFIVPKLE | 0.021 |
| 7 | IVPKLEHIEQ | 0.017 |
| 8 | VPKLEHIEQD | 0.010 |
| 1 | SEEIEFIVPK | 0.002 |
| 4 | IEFIVPKLEH | 0.001 |
| 9 | PKLEHIEQDE | 0.000 |
| | V7-HLA-A24-10mers-282P1G3 Each peptide is a portion of SEQ ID NO: 15; each start position is specified, the length of peptide is 10 amino acids, and the end position for each peptide is the start position plus nine. | |
| 7 | IVEDNISHEL | 11.088 |
| 3 | DFHVIVEDNI | 7.000 |
| 10 | DNISHELFTL | 6.000 |
| 8 | VEDNISHELF | 0.200 |
| 17 | FTLHPEPPRW | 0.150 |
| 18 | TLHPEPPRWT | 0.120 |
| 16 | LFTLHPEPPR | 0.050 |
| 20 | HPEPPRWTKK | 0.020 |
| 4 | FHVIVEDNIS | 0.018 |
| 6 | VIVEDNISHE | 0.018 |
| 5 | HVIVEDNISH | 0.015 |
| 9 | EDNISHELFT | 0.015 |
| 11 | NISHELFTLH | 0.014 |
| 2 | HDFHVIVEDN | 0.014 |
| 12 | ISHELFTLHP | 0.012 |
| 15 | ELFTLHPEPP | 0.010 |
| 14 | HELFTLHPEP | 0.002 |
| 19 | LHPEPPRWTK | 0.002 |
| 1 | THDFHVIVED | 0.002 |
| 13 | SHELFTLHPE | 0.002 |
| 21 | PEPPRWTKKP | 0.000 |

TABLE XVIII

| Start | Subsequence | Score |
|---|---|---|
| | V1-HLA-B7-9mers-282P1G3 Each peptide is a portion of SEQ ID NO: 3; each start position is specified, the length of peptide is 9 amino acids, and the end position for each peptide is the start position plus eight. | |
| 539 | NPRIPKLHM | 300.000 |
| 151 | LPCNPPKGL | 120.000 |

TABLE XVIII-continued

| Start | Subsequence | Score |
|---|---|---|
| 988 | TPSKPSWHL | 120.000 |
| 2 | EPLLLGRGL | 80.000 |
| 133 | LPKEKIDPL | 80.000 |
| 991 | KPSWHLSNL | 80.000 |
| 1172 | QPTESADSL | 80.000 |
| 542 | IPKLHMLEL | 80.000 |
| 954 | LPKKLNGNL | 80.000 |
| 154 | NPPKGLPPL | 80.000 |
| 247 | KQRKPKLLL | 60.000 |
| 6 | LGRGLIVYL | 40.000 |
| 626 | DVPDPPENL | 30.000 |
| 810 | GPDPQSVTL | 24.000 |
| 695 | FVRYQFRVI | 20.000 |
| 11 | IVYLMFLLL | 20.000 |
| 214 | IVQKMPMKL | 20.000 |
| 930 | GVPEQPTFL | 20.000 |
| 451 | TVVGYSAFL | 20.000 |
| 159 | LPPLHIYWM | 20.000 |
| 1106 | IALLTLLLL | 12.000 |
| 1101 | GLMCAIALL | 12.000 |
| 1001 | ATTKYKFYL | 12.000 |
| 130 | VPKLPKEKI | 12.000 |
| 828 | APVIHGVDV | 12.000 |
| 1105 | AIALLTLLL | 12.000 |
| 1104 | CAIALLTLL | 12.000 |
| 419 | ASNVHGTIL | 12.000 |
| 1163 | SLRSLNRDM | 10.000 |
| 210 | RLRTIVQKM | 10.000 |
| 285 | TPQVDWNKI | 8.000 |
| 47 | FPFDEYFQI | 8.000 |
| 726 | APDRNPQNI | 7.200 |
| 833 | GVDVINSTL | 6.000 |
| 772 | APVEWEEET | 6.000 |
| 942 | KVDKDTATL | 6.000 |
| 795 | APYDVKVQA | 6.000 |
| 1100 | IGLMCAIAL | 4.000 |
| 398 | FPREISFTN | 4.000 |
| 863 | INWWKTKSL | 4.000 |
| 267 | TILKGEILL | 4.000 |
| 9 | GLIVYLMFL | 4.000 |
| 946 | DTATLSWGL | 4.000 |
| 591 | NLTISNVTL | 4.000 |
| 10 | LIVYLMFLL | 4.000 |
| 268 | ILKGEILLL | 4.000 |
| 1127 | YSVKEKEDL | 4.000 |
| 950 | LSWGLPKKL | 4.000 |
| 266 | ITILKGEIL | 4.000 |
| 1214 | GSSTATFPL | 4.000 |
| 203 | CCFAAFPRL | 4.000 |
| 1103 | MCAIALLTL | 4.000 |
| 959 | NGNLTGYLL | 4.000 |
| 358 | YSTGSNGIL | 4.000 |
| 605 | YCCSAHTAL | 4.000 |
| 743 | EMIIKWEPL | 4.000 |
| 584 | RIIIDGANL | 4.000 |
| 125 | FIVPSVPKL | 4.000 |
| 163 | HIYWMNIEL | 4.000 |
| 890 | RNSGMVPSL | 4.000 |
| 1094 | STQGWFIGL | 4.000 |
| 359 | STGSNGILL | 4.000 |
| 1035 | IGKISGVNL | 4.000 |
| 682 | QGKKTTVIL | 4.000 |
| 245 | SIKQRKPKL | 4.000 |
| 958 | LNGNLTGYL | 4.000 |
| 855 | HGRLKGYQI | 4.000 |
| 206 | AAFPRLRTI | 3.600 |
| 730 | NPQNIRVQA | 3.000 |
| 111 | ASNKLGIAM | 3.000 |
| 433 | DVVDVRPLI | 3.000 |
| 787 | RVMTPAVYA | 2.250 |
| 250 | KPKLLPPT | 2.000 |
| 758 | GPGLEYRVT | 2.000 |
| 352 | KPQSAVYST | 2.000 |
| 208 | FPRLRTIVQ | 2.000 |
| 596 | NVTLEDQGI | 2.000 |
| 534 | RVSPKNPRI | 2.000 |
| 30 | SVQQVPTII | 2.000 |

TABLE XVIII-continued

| Start | Subsequence | Score |
|---|---|---|
| 785 | TLRVMTPAV | 2.000 |
| 385 | SPVDNHPFA | 2.000 |
| 671 | EPGRWEELT | 2.000 |
| 873 | DGRTHPKEV | 2.000 |
| 1019 | KPITEESST | 2.000 |
| 1121 | RNRGGKYSV | 2.000 |
| 737 | QASQPKEMI | 1.800 |
| 753 | SMEQNGPGL | 1.200 |
| 334 | TATHDFHVI | 1.200 |
| 916 | AGPESEPYI | 1.200 |
| 118 | AMSEEIEFI | 1.200 |
| 519 | TAVTANLDI | 1.200 |
| 180 | VYMSQKGDL | 1.200 |
| 261 | GSESSITIL | 1.200 |
| 738 | ASQPKEMII | 1.200 |
| 650 | AGADHNSNI | 1.200 |
| 611 | TALDSAADI | 1.200 |
| 901 | FSEFHLTVL | 1.200 |
| 1152 | YSDSDEKPL | 1.200 |
| 218 | MPMKLTVNS | 1.200 |
| 418 | EASNVHGTI | 1.200 |
| | V2-HLA-B7-9mers-(SET 1)-282P1G3 Each peptide is a portion of SEQ ID NO: 5; each start position is specified, the length of peptide is 9 amino acids, and the end position for each peptide is the start position plus eight. | |
| 9 | FPKEKIDPL | 80.000 |
| 6 | VPKFPKEKI | 12.000 |
| 3 | VPSVPKFPK | 0.300 |
| 5 | SVPKFPKEK | 0.050 |
| 2 | IVPSVPKFP | 0.050 |
| 1 | FIVPSVPKF | 0.020 |
| 4 | PSVPKFPKE | 0.001 |
| 8 | KFPKEKIDP | 0.001 |
| 7 | PKFPKEKID | 0.000 |
| | V2-HLA-B7-9mers-(SET 2)-282P1G3 Each peptide is a portion of SEQ ID NO: 5; each start position is specified, the length of peptide is 9 amino acids, and the end position for each peptide is the start position plus eight. | |
| 9 | AKENYGKTL | 0.360 |
| 8 | EAKENYGKT | 0.300 |
| 5 | KGREAKENY | 0.200 |
| 3 | LPKGREAKE | 0.200 |
| 2 | DLPKGREAK | 0.015 |
| 1 | GDLPKGREA | 0.010 |
| 7 | REAKENYGK | 0.001 |
| 6 | GREAKENYG | 0.000 |
| 4 | PKGREAKEN | 0.000 |
| | V2-HLA-B7-9mers-(SET 3)-282P1G3 Each peptide is a portion of SEQ ID NO: 5; each start position is specified, the length of peptide is 9 amino acids, and the end position for each peptide is the start position plus eight. | |
| 5 | LGEGKYAGL | 1.200 |
| 3 | STLGEGKYA | 0.100 |
| 9 | KYAGLYDDI | 0.040 |
| 2 | SSTLGEGKY | 0.020 |
| 7 | EGKYAGLYD | 0.010 |
| 1 | ESSTLGEGK | 0.010 |
| 4 | TLGEGKYAG | 0.010 |
| 6 | GEGKYAGLY | 0.002 |

TABLE XVIII-continued

| Start | Subsequence | Score |
|---|---|---|
| 8 | GKYAGLYDD | 0.001 |
| | V3-HLA-B7-9mers-282P1G3 Each peptide is a portion of SEQ ID NO: 7; each start position is specified, the length of peptide is 9 amino acids, and the end position for each peptide is the start position plus eight. | |
| 39 | LSYRNRNML | 6.000 |
| 31 | FICSKEQEL | 4.000 |
| 25 | SPQPSIFIC | 2.000 |
| 22 | ATGSPQPSI | 1.800 |
| 44 | RNMLAEDFI | 1.200 |
| 38 | ELSYRNRNM | 1.000 |
| 24 | GSPQPSIFI | 0.600 |
| 27 | QPSIFICSK | 0.200 |
| 8 | INTTYVSNT | 0.100 |
| 15 | NTTYVSNAT | 0.100 |
| 3 | HGVDVINTT | 0.100 |
| 12 | YVSNTTYVS | 0.100 |
| 58 | CNYVEKSST | 0.100 |
| 42 | RNRNMLAED | 0.100 |
| 6 | DVINTTYVS | 0.100 |
| 40 | SYRNRNMLA | 0.100 |
| 14 | SNTTYVSNA | 0.100 |
| 9 | NTTYVSNTT | 0.100 |
| 21 | NATGSPQPS | 0.060 |
| 18 | YVSNATGSP | 0.050 |
| 62 | EKSSTFFKI | 0.040 |
| 60 | YVEKSSTFF | 0.030 |
| 4 | GVDVINTTY | 0.030 |
| 10 | TTYVSNTTY | 0.020 |
| 32 | ICSKEQELS | 0.020 |
| 56 | TSCNYVEKS | 0.020 |
| 5 | VDVINTTYV | 0.020 |
| 13 | VSNTTYVSN | 0.020 |
| 51 | FIQKSTSCN | 0.020 |
| 53 | QKSTSCNYV | 0.020 |
| 33 | CSKEQELSY | 0.020 |
| 1 | VIHGVDVIN | 0.020 |
| 57 | SCNYVEKSS | 0.020 |
| 23 | TGSPQPSIF | 0.020 |
| 7 | VINTTYVSN | 0.020 |
| 52 | IQKSTSCNY | 0.020 |
| 11 | TYVSNTTYV | 0.020 |
| 47 | LAEDFIQKS | 0.018 |
| 16 | TTYVSNATG | 0.010 |
| 2 | IHGVDVINT | 0.010 |
| 46 | MLAEDFIQK | 0.010 |
| 45 | NMLAEDFIQ | 0.010 |
| 19 | VSNATGSPQ | 0.010 |
| 20 | SNATGSPQP | 0.010 |
| 54 | KSTSCNYVE | 0.010 |
| 50 | DFIQKSTSC | 0.010 |
| 29 | SIFICSKEQ | 0.010 |
| 55 | STSCNYVEK | 0.010 |
| 48 | AEDFIQKST | 0.009 |
| 37 | QELSYRNRN | 0.003 |
| 36 | EQELSYRNR | 0.003 |
| 59 | NYVEKSSTF | 0.002 |
| 26 | PQPSIFICS | 0.002 |
| 43 | NRNMLAEDF | 0.002 |
| 35 | KEQELSYRN | 0.002 |
| 17 | TYVSNATGS | 0.002 |
| 49 | EDFIQKSTS | 0.002 |
| 61 | VEKSSTFFK | 0.001 |
| 28 | PSIFICSKE | 0.001 |
| 41 | YRNRNMLAE | 0.001 |
| 30 | IFICSKEQE | 0.001 |
| 34 | SKEQELSYR | 0.000 |
| | V4-HLA-B7-9mers-282P1G3 Each peptide is a portion of SEQ ID NO: 9; each start | |

TABLE XVIII-continued

| Start | Subsequence | Score |
|---|---|---|
| | position is specified, the length of peptide is 9 amino acids, and the end position for each peptide is the start position plus eight. | |
| 1 | VTLYSGEDL | 4.000 |
| 8 | DLPEQPTFL | 4.000 |
| 9 | LPEQPTFLK | 0.090 |
| 4 | YSGEDLPEQ | 0.010 |
| 2 | TLYSGEDLP | 0.010 |
| 6 | GEDLPEQPT | 0.004 |
| 5 | SGEDLPEQP | 0.003 |
| 7 | EDLPEQPTF | 0.002 |
| 3 | LYSGEDLPE | 0.001 |
| | V5-HLA-B7-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 0.400 |
| 5 | TVNSSNSIK | 0.050 |
| 3 | KLTVNSSNS | 0.020 |
| 8 | SSNSIKQRK | 0.010 |
| 6 | VNSSNSIKQ | 0.010 |
| 7 | NSSNSIKQR | 0.010 |
| 9 | SNSIKQRKP | 0.010 |
| 2 | MKLTVNSSN | 0.002 |
| 1 | PMKLTVNSS | 0.002 |
| | V6-HLA-B7-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 1.200 |
| 5 | FIVPKLEHI | 0.400 |
| 7 | VPKLEHIEQ | 0.200 |
| 6 | IVPKLEHIE | 0.050 |
| 9 | KLEHIEQDE | 0.003 |
| 4 | EFIVPKLEH | 0.002 |
| 3 | IEFIVPKLE | 0.001 |
| 1 | EEIEFIVPK | 0.001 |
| 8 | PKLEHIEQD | 0.000 |
| | V7-HLA-B7-9mers-282P1G3 Each peptide is a portion of SEQ ID NO: 15; each start position is specified, the length of peptide is 9 amino acids, and the end position for each peptide is the start position plus eight. | |
| 10 | NISHELFTL | 4.000 |
| 19 | HPEPPRWTK | 0.135 |
| 7 | VEDNISHEL | 0.120 |
| 4 | HVIVEDNIS | 0.100 |
| 9 | DNISHELFT | 0.100 |
| 3 | FHVIVEDNI | 0.040 |
| 17 | TLHPEPPRW | 0.020 |
| 16 | FTLHPEPPR | 0.015 |
| 6 | IVEDNISHE | 0.015 |
| 18 | LHPEPPRWT | 0.015 |
| 11 | ISHELFTLH | 0.010 |
| 14 | ELFTLHPEP | 0.010 |
| 5 | VIVEDNISH | 0.010 |
| 8 | EDNISHELF | 0.002 |

TABLE XVIII-continued

| Start | Subsequence | Score |
|---|---|---|
| 2 | DFHVIVEDN | 0.002 |
| 13 | HELFTLHPE | 0.001 |
| 1 | HDFHVIVED | 0.001 |
| 15 | LFTLHPEPP | 0.001 |
| 12 | SHELFTLHP | 0.000 |
| 20 | PEPPRWTKK | 0.000 |

TABLE XIX

| Start | Subsequence | Score |
|---|---|---|
| | V1-HLA-B7-10mers-282P1G3 Each peptide is a portion of SEQ ID NO: 3; each start position is specified, the length of peptide is 10 amino acids, and the end position for each peptide is the start position plus nine. | |
| 398 | FPREISFTNL | 800.000 |
| 539 | NPRIPKLHML | 800.000 |
| 218 | MPMKLTVNSL | 240.000 |
| 1054 | EPGAEHIVRL | 80.000 |
| 1158 | KPLKGSLRSL | 80.000 |
| 849 | VPKDRVHGRL | 80.000 |
| 536 | SPKNPRIPKL | 80.000 |
| 1019 | KPITEESSTL | 80.000 |
| 1080 | ETRGREYAGL | 40.000 |
| 828 | APVIHGVDVI | 24.000 |
| 627 | VPDPPENLHL | 24.000 |
| 795 | APYDVKVQAI | 24.000 |
| 798 | DVKVQAINQL | 20.000 |
| 179 | RVYMSQKGDL | 20.000 |
| 1105 | AIALLTLLLL | 12.000 |
| 693 | APFVRYQFRV | 12.000 |
| 752 | KSMEQNGPGL | 12.000 |
| 450 | ATVVGYSAFL | 12.000 |
| 772 | APVEWEEETV | 12.000 |
| 1000 | NATTKYKFYL | 12.000 |
| 480 | KPLEGRRYHI | 12.000 |
| 590 | ANLTISNVTL | 12.000 |
| 418 | EASNVHGTIL | 12.000 |
| 2 | EPLLLGRGLI | 12.000 |
| 1104 | CAIALLTLLL | 12.000 |
| 616 | AADITQVTVL | 10.800 |
| 6 | LGRGLIVYLM | 10.000 |
| 74 | NPFYFTDHRI | 8.000 |
| 695 | FVRYQFRVIA | 7.500 |
| 356 | AVYSTGSNGI | 6.000 |
| 150 | VLPCNPPKGL | 6.000 |
| 142 | EVEEGDPIVL | 6.000 |
| 987 | TTPSKPSWHL | 6.000 |
| 643 | SVRLTWEAGA | 5.000 |
| 735 | RVQASQPKEM | 5.000 |
| 780 | TVTNHTLRVM | 5.000 |
| 863 | INWWKTKSLL | 4.000 |
| 790 | TPAVYAPYDV | 4.000 |
| 1034 | GIGKISGVNL | 4.000 |
| 266 | ITILKGEILL | 4.000 |
| 1103 | MCAIALLTLL | 4.000 |
| 9 | GLIVYLMFLL | 4.000 |
| 953 | GLPKKLNGNL | 4.000 |
| 323 | NYRCTASNFL | 4.000 |
| 106 | KYRCFASNKL | 4.000 |
| 862 | QINWWKTKSL | 4.000 |
| 274 | LLLECFAEGL | 4.000 |
| 541 | RIPKLHMLEL | 4.000 |
| 260 | SGSESSITIL | 4.000 |
| 949 | TLSWGLPKKL | 4.000 |
| 213 | TIVQKMPMKL | 4.000 |
| 557 | DSHLKHSLKL | 4.000 |
| 957 | KLNGNLTGYL | 4.000 |

TABLE XIX-continued

| Start | Subsequence | Score |
|---|---|---|
| 1102 | LMCAIALLTL | 4.000 |
| 1093 | ISTQGWFIGL | 4.000 |
| 934 | QPTFLKVIKV | 4.000 |
| 132 | KLPKEKIDPL | 4.000 |
| 5 | LLGRGLIVYL | 4.000 |
| 8 | RGLIVYLMFL | 4.000 |
| 832 | HGVDVINSTL | 4.000 |
| 1099 | FIGLMCAIAL | 4.000 |
| 267 | TILKGEILLL | 4.000 |
| 929 | EGVPEQPTFL | 4.000 |
| 516 | IGKTAVTANL | 4.000 |
| 202 | YCCFAAFPRL | 4.000 |
| 473 | WQKVEEVKPL | 4.000 |
| 244 | NSIKQRKPKL | 4.000 |
| 373 | EPQPTIKWRV | 4.000 |
| 1171 | MQPTESADSL | 4.000 |
| 302 | ETKENYGKTL | 4.000 |
| 681 | VQGKKTTVIL | 4.000 |
| 1213 | NGSSTATFPL | 4.000 |
| 1100 | IGLMCAIALL | 4.000 |
| 809 | SGPDPQSVTL | 4.000 |
| 958 | LNGNLTGYLL | 4.000 |
| 358 | YSTGSNGILL | 4.000 |
| 637 | SERQNRSVRL | 4.000 |
| 153 | CNPPKGLPPL | 4.000 |
| 875 | RTHPKEVNIL | 4.000 |
| 1172 | QPTESADSLV | 4.000 |
| 265 | SITILKGEIL | 4.000 |
| 245 | SIKQRKPKLL | 4.000 |
| 34 | VPTIIKQSKV | 4.000 |
| 10 | LIVYLMFLLL | 4.000 |
| 725 | AAPDRNPQNI | 3.600 |
| 117 | IAMSEEIEFI | 3.600 |
| 110 | FASNKLGIAM | 3.000 |
| 792 | AVYAPYDVKV | 3.000 |
| 413 | AVYQCEASNV | 3.000 |
| 129 | SVPKLPKEKI | 3.000 |
| 206 | AAFPRLRTIV | 2.700 |
| 1048 | HPIEVFEPGA | 2.000 |
| 680 | RVQGKKTTVI | 2.000 |
| 27 | IPSSVQQVPT | 2.000 |
| 526 | DIRNATKLRV | 2.000 |
| 408 | QPNHTAVYQC | 2.000 |
| 1051 | EVFEPGAEHI | 2.000 |
| 954 | LPKKLNGNLT | 2.000 |
| 208 | FPRLRTIVQK | 2.000 |
| 538 | KNPRIPKLHM | 1.500 |
| | V2-HLA-B7-10mers-(SET 1)-282P1G3 Each peptide is a portion of SEQ ID NO: 5; each start position is specified, the length of peptide is 10 amino acids, and the end position for each peptide is the start position plus nine. | |
| 6 | SVPKFPKEKI | 3.000 |
| 9 | KFPKEKIDPL | 0.400 |
| 7 | VPKFPKEKID | 0.200 |
| 4 | VPSVPKFPKE | 0.200 |
| 10 | FPKEKIDPLE | 0.200 |
| 3 | IVPSVPKFPK | 0.075 |
| 2 | FIVPSVPKFP | 0.010 |
| 1 | EFIVPSVPKF | 0.002 |
| 5 | PSVPKFPKEK | 0.001 |
| 8 | PKFPKEKIDP | 0.000 |
| | V2-HLA-B7-10mers-(SET 2)-282P1G3 Each peptide is a portion of SEQ ID NO: 5; each start position is specified, the length of peptide is 10 amino acids, and the end position for each peptide is the start position plus nine. | |

TABLE XIX-continued

| Start | Subsequence | Score |
|---|---|---|
| 4 | TLGEGKYAGL | 4.000 |
| 2 | SSTLGEGKYA | 0.100 |
| 8 | GKYAGLYDDI | 0.040 |
| 1 | ESSTLGEGKY | 0.020 |
| 3 | STLGEGKYAG | 0.010 |
| 7 | EGKYAGLYDD | 0.010 |
| 5 | LGEGKYAGLY | 0.006 |
| 6 | GEGKYAGLYD | 0.001 |
| | V2-HLA-B7-10mers-(SET 3)-282P1G3 Each peptide is a portion of SEQ ID NO: 5; each start position is specified, the length of peptide is 10 amino acids, and the end position for each peptide is the start position plus nine. | |
| 5 | TLGEGKYAGL | 4.000 |
| 3 | SSTLGEGKYA | 0.100 |
| 9 | GKYAGLYDDI | 0.040 |
| 2 | ESSTLGEGKY | 0.020 |
| 4 | STLGEGKYAG | 0.010 |
| 8 | EGKYAGLYDD | 0.010 |
| 6 | LGEGKYAGLY | 0.006 |
| 10 | KYAGLYDDIS | 0.002 |
| 7 | GEGKYAGLYD | 0.001 |
| 1 | EESSTLGEGK | 0.001 |
| | V3-HLA-B7-10mers-282P1G3 Each peptide is a portion of SEQ ID NO: 7; each start position is specified, the length of peptide is 10 amino acids, and the end position for each peptide is the start position plus nine. | |
| 39 | ELSYRNRNML | 6.000 |
| 22 | NATGSPQPSI | 1.800 |
| 24 | TGSPQPSIFI | 0.600 |
| 31 | IFICSKEQEL | 0.400 |
| 26 | SPQPSIFICS | 0.400 |
| 5 | GVDVINTTYV | 0.300 |
| 53 | IQKSTSCNYV | 0.200 |
| 28 | QPSIFICSKE | 0.200 |
| 11 | TTYVSNTTYV | 0.200 |
| 43 | RNRNMLAEDF | 0.200 |
| 8 | VINTTYVSNT | 0.100 |
| 15 | SNTTYVSNAT | 0.100 |
| 58 | SCNYVEKSST | 0.100 |
| 38 | QELSYRNRNM | 0.100 |
| 9 | INTTYVSNTT | 0.100 |
| 14 | VSNTTYVSNA | 0.100 |
| 7 | DVINTTYVSN | 0.100 |
| 2 | VIHGVDVINT | 0.100 |
| 25 | GSPQPSIFIC | 0.100 |
| 40 | LSYRNRNMLA | 0.100 |
| 13 | YVSNTTYVSN | 0.100 |
| 48 | LAEDFIQKST | 0.090 |
| 23 | ATGSPQPSIF | 0.060 |
| 19 | YVSNATGSPQ | 0.050 |
| 62 | VEKSSTFFKI | 0.040 |
| 44 | NRNMLAEDFI | 0.040 |
| 45 | RNMLAEDFIQ | 0.030 |
| 17 | TTYVSNATGS | 0.020 |
| 47 | MLAEDFIQKS | 0.020 |
| 10 | NTTYVSNTTY | 0.020 |
| 32 | FICSKEQELS | 0.020 |
| 59 | CNYVEKSSTF | 0.020 |
| 21 | SNATGSPQPS | 0.020 |
| 52 | FIQKSTSCNY | 0.020 |
| 56 | STSCNYVEKS | 0.020 |
| 4 | HGVDVINTTY | 0.020 |
| 57 | TSCNYVEKSS | 0.020 |
| 33 | ICSKEQELSY | 0.020 |
| 61 | YVEKSSTFFK | 0.015 |

TABLE XIX-continued

| Start | Subsequence | Score |
|---|---|---|
| 16 | NTTYVSNATG | 0.010 |
| 1 | PVIHGVDVIN | 0.010 |
| 20 | VSNATGSPQP | 0.010 |
| 41 | SYRNRNMLAE | 0.010 |
| 34 | CSKEQELSYR | 0.010 |
| 30 | SIFICSKEQE | 0.010 |
| 50 | EDFIQKSTSC | 0.010 |
| 55 | KSTSCNYVEK | 0.010 |
| 3 | IHGVDVINTT | 0.010 |
| 46 | NMLAEDFIQK | 0.010 |
| 37 | EQELSYRNRN | 0.009 |
| 60 | NYVEKSSTFF | 0.002 |
| 51 | DFIQKSTSCN | 0.002 |
| 12 | TYVSNTTYVS | 0.002 |
| 6 | VDVINTTYVS | 0.002 |
| 49 | AEDFIQKSTS | 0.002 |
| 36 | KEQELSYRNR | 0.001 |
| 29 | PSIFICSKEQ | 0.001 |
| 54 | QKSTSCNYVE | 0.001 |
| 27 | PQPSIFICSK | 0.001 |
| 42 | YRNRNMLAED | 0.001 |
| 18 | TYVSNATGSP | 0.001 |
| 35 | SKEQELSYRN | 0.001 |
| | V4-HLA-B7-10mers-282P1G3 Each peptide is a portion of SEQ ID NO: 9; each start position is specified, the length of peptide is 10 amino acids, and the end position for each peptide is the start position plus nine. | |
| 1 | SVTLYSGEDL | 20.000 |
| 10 | LPEQPTFLKV | 1.200 |
| 8 | EDLPEQPTFL | 0.400 |
| 6 | SGEDLPEQPT | 0.045 |
| 9 | DLPEQPTFLK | 0.015 |
| 3 | TLYSGEDLPE | 0.010 |
| 5 | YSGEDLPEQP | 0.010 |
| 2 | VTLYSGEDLP | 0.010 |
| 4 | LYSGEDLPEQ | 0.001 |
| 7 | GEDLPEQPTF | 0.001 |
| | V5-HLA-B7-10mers-282P1G3 Each peptide is a portion of SEQ ID NO: 11; each start position is specified, the length of peptide is 10 amino acids, and the end position for each peptide is the start position plus nine. | |
| 1 | MPMKLTVNSS | 1.200 |
| 4 | KLTVNSSNSI | 0.400 |
| 6 | TVNSSNSIKQ | 0.050 |
| 10 | SNSIKQRKPK | 0.015 |
| 7 | VNSSNSIKQR | 0.010 |
| 8 | NSSNSIKQRK | 0.010 |
| 9 | SSNSIKQRKP | 0.010 |
| 5 | LTVNSSNSIK | 0.010 |
| 2 | PMKLTVNSSN | 0.002 |
| 3 | MKLTVNSSNS | 0.002 |
| | V6-HLA-B7-10mers-282P1G3 Each peptide is a portion of SEQ ID NO: 13; each start position is specified, the length of peptide is 10 amino acids, and the end position for each peptide is the start position plus nine. | |
| 2 | EEIEFIVPKL | 0.400 |
| 8 | VPKLEHIEQD | 0.200 |
| 7 | IVPKLEHIEQ | 0.050 |
| 5 | EFIVPKLEHI | 0.040 |

TABLE XIX-continued

| Start | Subsequence | Score |
|---|---|---|
| 6 | FIVPKLEHIE | 0.010 |
| 10 | KLEHIEQDER | 0.003 |
| 3 | EIEFIVPKLE | 0.003 |
| 4 | IEFIVPKLEH | 0.002 |
| 1 | SEEIEFIVPK | 0.000 |
| 9 | PKLEHIEQDE | 0.000 |
| | V7-HLA-B7-10mers-282P1G3 Each peptide is a portion of SEQ ID NO: 15; each start position is specified, the length of peptide is 10 amino acids, and the end position for each peptide is the start position plus nine. | |
| 7 | IVEDNISHEL | 6.000 |
| 10 | DNISHELFTL | 4.000 |
| 18 | TLHPEPPRWT | 0.150 |
| 20 | HPEPPRWTKK | 0.060 |
| 5 | HVIVEDNISH | 0.050 |
| 3 | DFHVIVEDNI | 0.040 |
| 17 | FTLHPEPPRW | 0.020 |
| 6 | VIVEDNISHE | 0.010 |
| 15 | ELFTLHPEPP | 0.010 |
| 11 | NISHELFTLH | 0.010 |
| 12 | ISHELFTLHP | 0.010 |
| 9 | EDNISHELFT | 0.010 |
| 19 | LHPEPPRWTK | 0.002 |
| 2 | HDFHVIVEDN | 0.002 |
| 4 | FHVIVEDNIS | 0.002 |
| 16 | LFTLHPEPPR | 0.002 |
| 14 | HELFTLHPEP | 0.001 |
| 8 | VEDNISHELF | 0.001 |
| 13 | SHELFTLHPE | 0.000 |
| 1 | THDFHVIVED | 0.000 |
| 21 | PEPPRWTKKP | 0.000 |

TABLE XX

| Start | Subsequence | Score |
|---|---|---|
| | V1-HLA-B3501-9mers-282P1G3 Each peptide is a portion of SEQ ID NO: 3; each start position is specified, the length of peptide is 9 amino acids, and and the end position for each peptide is the start position plus eight. | |
| 539 | NPRIPKLHM | 120.000 |
| 133 | LPKEKIDPL | 120.000 |
| 740 | QPKEMIIKW | 60.000 |
| 542 | IPKLHMLEL | 60.000 |
| 954 | LPKKLNGNL | 60.000 |
| 991 | KPSWHLSNL | 40.000 |
| 159 | LPPLHIYWM | 40.000 |
| 690 | LPLAPFVRY | 40.000 |
| 1172 | QPTESADSL | 40.000 |
| 130 | VPKLPKEKI | 24.000 |
| 299 | KGRETKENY | 24.000 |
| 1082 | RGREYAGLY | 24.000 |
| 47 | FPFDEYFQI | 24.000 |
| 197 | DSRNDYCCF | 22.500 |
| 151 | LPCNPPKGL | 20.000 |
| 1175 | ESADSLVEY | 20.000 |
| 390 | HPFAGDVVF | 20.000 |
| 2 | EPLLLGRGL | 20.000 |
| 988 | TPSKPSWHL | 20.000 |
| 154 | NPPKGLPPL | 20.000 |
| 768 | KPQGAPVEW | 20.000 |
| 84 | IPSNNSGTF | 20.000 |

TABLE XX-continued

| Start | Subsequence | Score |
|---|---|---|
| 316 | VSYQDKGNY | 15.000 |
| 285 | TPQVDWNKI | 12.000 |
| 398 | FPREISFTN | 12.000 |
| 250 | KPKLLLPPT | 12.000 |
| 69 | WTKDGNPFY | 12.000 |
| 210 | RLRTIVQKM | 12.000 |
| 111 | ASNKLGIAM | 10.000 |
| 886 | FSGQRNSGM | 10.000 |
| 917 | GPESEPYIF | 9.000 |
| 915 | GAGPESEPY | 9.000 |
| 310 | TLKIENVSY | 9.000 |
| 1127 | YSVKEKEDL | 7.500 |
| 384 | GSPVDNHPF | 7.500 |
| 1000 | NATTKYKFY | 6.000 |
| 1019 | KPITEESST | 6.000 |
| 810 | GPDPQSVTL | 6.000 |
| 597 | VTLEDQGIY | 6.000 |
| 1163 | SLRSLNRDM | 6.000 |
| 247 | KQRKPKLLL | 6.000 |
| 1214 | GSSTATFPL | 5.000 |
| 950 | LSWGLPKKL | 5.000 |
| 455 | YSAFLHCEF | 5.000 |
| 465 | ASPEAVVSW | 5.000 |
| 182 | MSQKGDLYF | 5.000 |
| 358 | YSTGSNGIL | 5.000 |
| 419 | ASNVHGTIL | 5.000 |
| 667 | GNKEEPGRW | 4.500 |
| 117 | IAMSEEIEF | 4.500 |
| 268 | ILKGEILLL | 4.500 |
| 1158 | KPLKGSLRS | 4.000 |
| 385 | SPVDNHPFA | 4.000 |
| 853 | RVHGRLKGY | 4.000 |
| 957 | KLNGNLTGY | 4.000 |
| 828 | APVIHGVDV | 4.000 |
| 352 | KPQSAVYST | 4.000 |
| 795 | APYDVKVQA | 4.000 |
| 157 | KGLPPLHIY | 4.000 |
| 772 | APVEWEEET | 4.000 |
| 629 | DPPENLHLS | 4.000 |
| 212 | RTIVQKMPM | 4.000 |
| 1104 | CAIALLTLL | 3.000 |
| 682 | QGKKTTVIL | 3.000 |
| 692 | LAPFVRYQF | 3.000 |
| 45 | VAFPFDEYF | 3.000 |
| 441 | IQTKDGENY | 3.000 |
| 1106 | IALLTLLLL | 3.000 |
| 6 | LGRGLIVYL | 3.000 |
| 1035 | IGKISGVNL | 3.000 |
| 857 | RLKGYQINW | 3.000 |
| 456 | SAFLHCEFF | 3.000 |
| 758 | GPGLEYRVT | 3.000 |
| 584 | RIIIDGANL | 3.000 |
| 245 | SIKQRKPKL | 3.000 |
| 838 | NSTLVKVTW | 2.500 |
| 726 | APDRNPQNI | 2.400 |
| 611 | TALDSAADI | 2.400 |
| 23 | KAIEIPSSV | 2.400 |
| 1152 | YSDSDEKPL | 2.250 |
| 5 | LLGRGLIVY | 2.000 |
| 997 | SNLNATTKY | 2.000 |
| 738 | ASQPKEMII | 2.000 |
| 722 | TPPAAPDRN | 2.000 |
| 181 | YMSQKGDLY | 2.000 |
| 657 | NISEYIVEF | 2.000 |
| 812 | DPQSVTLYS | 2.000 |
| 890 | RNSGMVPSL | 2.000 |
| 626 | DVPDPPENL | 2.000 |
| 39 | KQSKVQVAF | 2.000 |
| 44 | QVAFPFDEY | 2.000 |
| 730 | NPQNIRVQA | 2.000 |
| 283 | LPTPQVDWN | 2.000 |
| 508 | YSCWVENAI | 2.000 |
| 8 | RGLIVYLMF | 2.000 |
| 99 | HISHFQGKY | 2.000 |
| 736 | VQASQPKEM | 2.000 |
| 447 | ENYATVVGY | 2.000 |
| 755 | EQNGPGLEY | 2.000 |

TABLE XX-continued

| Start | Subsequence | Score |
|---|---|---|
| 1013 | TSQGCGKPI | 2.000 |
| | V2-HLA-B3501-9mers-(SET 1)-282P1G3 Each peptide is a portion of SEQ ID NO: 5; each start position is specified, the length of peptide is 9 amino acids, and the end position for each peptide is the start position plus eight. | |
| 9 | FPKEKIDPL | 120.000 |
| 6 | VPKFPKEKI | 24.000 |
| 1 | FIVPSVPKF | 1.000 |
| 3 | VPSVPKFPK | 0.200 |
| 5 | SVPKFPKEK | 0.010 |
| 2 | IVPSVPKFP | 0.010 |
| 4 | PSVPKFPKE | 0.005 |
| 8 | KFPKEKIDP | 0.003 |
| 7 | PKFPKEKID | 0.000 |
| | V2-B3501-9mers-(SET 2)-282P1G3 Each peptide is a portion of SEQ ID NO: 5; each start position is specified, the length of peptide is 9 amino acids, and the end position for each peptide is the start position plus eight. | |
| 5 | KGREAKENY | 24.000 |
| 8 | EAKENYGKT | 1.800 |
| 3 | LPKGREAKE | 0.600 |
| 9 | AKENYGKTL | 0.030 |
| 1 | GDLPKGREA | 0.010 |
| 2 | DLPKGREAK | 0.010 |
| 7 | REAKENYGK | 0.003 |
| 4 | PKGREAKEN | 0.002 |
| 6 | GREAKENYG | 0.000 |
| | V2-B3501-9mers-(SET 3)-282P1G3 Each peptide is a portion of SEQ ID NO: 5; each start position is specified, the length of peptide is 9 amino acids, and the end position for each peptide is the start position plus eight. | |
| 2 | SSTLGEGKY | 10.000 |
| 5 | LGEGKYAGL | 0.300 |
| 6 | GEGKYAGLY | 0.200 |
| 3 | STLGEGKYA | 0.150 |
| 9 | KYAGLYDDI | 0.080 |
| 1 | ESSTLGEGK | 0.050 |
| 7 | EGKYAGLYD | 0.030 |
| 4 | TLGEGKYAG | 0.020 |
| 8 | GKYAGLYDD | 0.001 |
| | V3-B3501-9mers-282P1G3 Each peptide is a portion of SEQ ID NO: 7; each start position is specified, the length of peptide is 9 amino acids, and the end position for each peptide is the start position plus eight. | |
| 33 | CSKEQELSY | 60.00 |
| 52 | IQKSTSCNY | 6.000 |
| 39 | LSYRNRNML | 5.000 |
| 10 | TTYVSNTTY | 2.000 |
| 24 | GSPQPSIFI | 2.000 |
| 25 | SPQPSIFIC | 2.000 |
| 38 | ELSYRNRNM | 2.000 |
| 31 | FICSKEQEL | 1.000 |
| 23 | TGSPQPSIF | 1.000 |

TABLE XX-continued

| Start | Subsequence | Score |
|---|---|---|
| 44 | RNMLAEDFI | 0.800 |
| 4 | GVDVINTTY | 0.600 |
| 56 | TSCNYVELS | 0.500 |
| 13 | VSNTTYVSN | 0.500 |
| 22 | ATGSPQPSI | 0.400 |
| 60 | YVEKSSTFF | 0.300 |
| 21 | NATGSPQPS | 0.300 |
| 59 | NYVEKSSTF | 0.200 |
| 3 | HGVDVINTT | 0.200 |
| 27 | QPSIFICSK | 0.200 |
| 47 | LAEDFIQKS | 0.180 |
| 32 | ICSKEQELS | 0.150 |
| 58 | CNYVEKSST | 0.150 |
| 9 | NTTYVSNTT | 0.100 |
| 7 | VINTTYVSN | 0.100 |
| 54 | KSTSCNYVE | 0.100 |
| 15 | NTTYVSNAT | 0.100 |
| 8 | INTTYVSNT | 0.100 |
| 12 | YVSNTTYVS | 0.100 |
| 51 | FIQKSTSCN | 0.100 |
| 43 | NRNMLAEDF | 0.100 |
| 57 | SCNYVEKSS | 0.100 |
| 1 | VIHGVDVIN | 0.100 |
| 14 | SNTTYVSNA | 0.100 |
| 6 | DVINTTYVS | 0.100 |
| 42 | RNRNMLAED | 0.060 |
| 19 | VSNATGSPQ | 0.050 |
| 35 | KEQELSYRN | 0.040 |
| 62 | EKSSTFFKI | 0.040 |
| 46 | MLAEDFIQK | 0.030 |
| 40 | SYRNRNMLA | 0.030 |
| 5 | VDVINTTYV | 0.020 |
| 11 | TYVSNTTYN | 0.020 |
| 53 | QKSTSCNYV | 0.020 |
| 2 | IHGVDVINT | 0.015 |
| 45 | NMLAEDFIQ | 0.015 |
| 26 | PQPSIFICS | 0.010 |
| 49 | EDFIQKSTS | 0.010 |
| 16 | TTYVSNATG | 0.010 |
| 37 | QELSYRNRN | 0.010 |
| 55 | STSCNYVEK | 0.010 |
| 17 | RYVSNATGS | 0.010 |
| 29 | SIFICSKEQ | 0.010 |
| 18 | YVSNATGSP | 0.010 |
| 20 | SNATGSPQP | 0.010 |
| 50 | DFIQKSTSC | 0.010 |
| 28 | PSIFICSKE | 0.005 |
| 61 | VEKSSTFFK | 0.003 |
| 48 | AEDFIQKST | 0.003 |
| 36 | EQELSYRNR | 0.003 |
| 30 | IFICSKEQE | 0.001 |
| 41 | YRNRNMLAE | 0.001 |
| 34 | SKEQELSYR | 0.000 |
| | V4-HLA-B3501-9mers-282P1G3 Each peptide is a portion of SEQ ID NO: 9; each start position is specified, the length of peptide is 9 amino acids, and the end position for each peptide is the start position plus eight. | |
| 8 | DLPEQPTFL | 2.000 |
| 1 | VTLYSGEDL | 1.000 |
| 7 | EDLPEQPTF | 0.150 |
| 4 | YSGEDLPEQ | 0.150 |
| 9 | LPEQPTFLK | 0.060 |
| 2 | TLYSGEDLP | 0.010 |
| 5 | SGEDLPEQP | 0.006 |
| 6 | GEDLPEQPT | 0.003 |
| 3 | LYSGEDLPE | 0.002 |
| | V5-HLA-B3501-9mers-282P1G3 Each peptide is a portion of SEQ ID NO: 11; each start position is specified, the | |

TABLE XX-continued

| Start | Subsequence | Score |
|---|---|---|
| | length of peptide is 9 amino acids, and the end position for each peptide is the start position plus eight. | |
| 4 | LTVNSSNSI | 0.400 |
| 3 | KLTVNSSNS | 0.200 |
| 8 | SSNSIKQRK | 0.050 |
| 7 | NSSNSIKQR | 0.050 |
| 1 | PMKLTVNSS | 0.030 |
| 9 | SNSIKQRKP | 0.010 |
| 6 | VNSSNSIKQ | 0.010 |
| 2 | MKLTVNSSN | 0.010 |
| 5 | TVNSSNSIK | 0.010 |
| | V6-HLA-B3501-9mers-282P1G3 Each peptide is a portion of SEQ ID NO: 13; each start position is specified, the length of peptide is 9 amino acids, and the end position for each peptide is the start position plus eight. | |
| 7 | VPKLEHIEQ | 0.900 |
| 5 | FIVPKLEHI | 0.400 |
| 2 | EIEFIVPKL | 0.300 |
| 6 | IVPKLEHIE | 0.010 |
| 9 | KLEHIEQDE | 0.006 |
| 1 | EEIEFIVPK | 0.002 |
| 4 | EFIVPKLEH | 0.001 |
| 3 | IEFIVPKLE | 0.001 |
| 8 | PKLEHIEQD | 0.000 |
| | V7-HLA-B3501-9mers-282P1G3 Each peptide is a portion of SEQ ID NO: 15; each start position is specified, the length of peptide is 9 amino acids, and the end position for each peptide is the start position plus eight. | |
| 10 | NISHELFTL | 1.500 |
| 17 | TLHPEPPRW | 0.750 |
| 4 | HVIVEDNIS | 0.150 |
| 11 | ISHELFTLH | 0.100 |
| 8 | EDNISHELF | 0.100 |
| 9 | DNISHELFT | 0.100 |
| 19 | HPEPPRWTK | 0.060 |
| 3 | FHVIVEDNI | 0.040 |
| 5 | VIVEDNISH | 0.030 |
| 7 | VEDNISHEL | 0.030 |
| 18 | LHPEPPRWT | 0.020 |
| 2 | DFHVIVEDN | 0.010 |
| 16 | FTLHPEPPR | 0.010 |
| 14 | ELFTLHPEP | 0.010 |
| 6 | IVEDNISHE | 0.006 |
| 13 | HELFTLHPE | 0.001 |
| 1 | HDFHVIVED | 0.001 |
| 15 | LFTLHPEPP | 0.001 |
| 12 | SHELFTLHP | 0.000 |
| 20 | PEPPRWTKK | 0.000 |

TABLE XXI

| Start | Subsequence | Score |
|---|---|---|
| | V1-HLA-B35-10mers-282P1G3 Each peptide is a portion of SEQ ID NO: 3; each start position is specified, the length of peptide is 10 amino acids, | |

TABLE XXI-continued

| Start | Subsequence | Score |
|---|---|---|
| | and the end position for each peptide is the start position plus nine. | |
| 398 | FPREISFTNL | 120.000 |
| 849 | VPKDRVHGRL | 120.000 |
| 877 | HPKEVNILRF | 120.000 |
| 539 | NPRIPKLHML | 60.000 |
| 1019 | KPITEESSTL | 60.000 |
| 536 | SPKNPRIPKL | 60.000 |
| 1158 | KPLKGSLRSL | 40.000 |
| 94 | IPNEGHISHF | 40.000 |
| 480 | KPLEGRRYHI | 32.000 |
| 218 | MPMKLTVNSL | 20.000 |
| 1054 | EPGAEHIVRL | 20.000 |
| 895 | VPSLDAFSEF | 20.000 |
| 752 | KSMEQNGPGL | 20.000 |
| 568 | WSKDGEAFEI | 18.000 |
| 795 | APYDVKVQAI | 16.000 |
| 40 | QSKVQVAFPF | 15.000 |
| 1143 | SVKDETFGEY | 12.000 |
| 810 | GPDPQSVTLY | 12.000 |
| 499 | RTTEEDAGSY | 12.000 |
| 772 | APVEWEEETV | 12.000 |
| 996 | LSNLNATTKY | 10.000 |
| 758 | GPGLEYRVTW | 10.000 |
| 1162 | GSLRSLNRDM | 10.000 |
| 297 | LPKGRETKEN | 9.000 |
| 58 | EAKGNPEPTF | 9.000 |
| 478 | EVKPLEGRRY | 9.000 |
| 627 | VPDPPENLHL | 9.000 |
| 828 | APVIHGVDVI | 8.000 |
| 74 | NPFYFTDHRI | 8.000 |
| 1172 | QPTESADSLV | 8.000 |
| 2 | EPLLLGRGLI | 8.000 |
| 566 | LSWSKDGEAF | 7.500 |
| 67 | FSWTKDGNPF | 7.500 |
| 110 | FASNKLGIAM | 6.000 |
| 309 | KTLKIENVSY | 6.000 |
| 349 | WTKKPQSAVY | 6.000 |
| 69 | WTKDGNPFYF | 6.000 |
| 785 | TLRVMTPAVY | 6.000 |
| 6 | LGRGLIVYLM | 6.000 |
| 302 | ETKENYGKTL | 6.000 |
| 954 | LPKKLNGNLT | 6.000 |
| 1118 | FVKRNRGGKY | 6.000 |
| 745 | IIKWEPLKSM | 6.000 |
| 914 | KGAGPESEPY | 6.000 |
| 1211 | ESNGSSTATF | 5.000 |
| 244 | NSIKQRKPKL | 5.000 |
| 455 | YSAFLHCEFF | 5.000 |
| 557 | DSHLKHSLKL | 5.000 |
| 358 | YSTGSNGILL | 5.000 |
| 1093 | ISTQGWFIGL | 5.000 |
| 473 | WQKVEEVKPL | 4.500 |
| 1080 | ETRGREYAGL | 4.500 |
| 934 | QPTFLKVIKV | 4.000 |
| 735 | RVQASQPKEM | 4.000 |
| 1077 | DVIETRGREY | 4.000 |
| 991 | KPSWHLSNLN | 4.000 |
| 693 | APFVRYQFRV | 4.000 |
| 373 | EPQPTIKWRV | 4.000 |
| 34 | VPTIIKQSKV | 4.000 |
| 1048 | HPIEVFEPGA | 4.000 |
| 538 | KNPRIPKLHM | 4.000 |
| 790 | TPAVYAPYDV | 4.000 |
| 440 | LIQTKDGENY | 3.000 |
| 315 | NVSYQDKGNY | 3.000 |
| 449 | YATVVGYSAF | 3.000 |
| 916 | AGPESEPYIF | 3.000 |
| 516 | IGKTAVTANL | 3.000 |
| 1203 | GSKEKGSVES | 3.000 |
| 798 | DVKVQAINQL | 3.000 |
| 1000 | NATTKYKFYL | 3.000 |
| 1044 | TQKTHPIEVF | 3.000 |
| 418 | EASNVHGTIL | 3.000 |
| 596 | NVTLEDQGIY | 3.000 |

TABLE XXI-continued

| Start | Subsequence | Score |
|---|---|---|
| 875 | RTHPKEVNIL | 3.000 |
| 857 | RLKGYQINWW | 3.000 |
| 1104 | CAIALLTLLL | 3.000 |
| 245 | SIKQRKPKLL | 3.000 |
| 725 | AAPDRNPQNI | 2.400 |
| 155 | PPKGLPPLHI | 2.400 |
| 21 | FSKAIEIPSS | 2.250 |
| 274 | LLLECFAEGL | 2.000 |
| 159 | LPPLHIYWMN | 2.000 |
| 957 | KLNGNLTGYL | 2.000 |
| 132 | KLPKEKIDPL | 2.000 |
| 43 | VQVAFPFDEY | 2.000 |
| 29 | SSVQQVPTII | 2.000 |
| 264 | SSITILKGEI | 2.000 |
| 988 | TPSKPSWHLS | 2.000 |
| 260 | SGSESSITIL | 2.000 |
| 689 | ILPLAPFVRY | 2.000 |
| 158 | GLPPLHIYWM | 2.000 |
| 780 | TVTNHTLRVM | 2.000 |
| 4 | LLLGRGLIVY | 2.000 |
| 960 | GNLTGYLLQY | 2.000 |
| 967 | LQYQIINDTY | 2.000 |
| 255 | LPPTESGSES | 2.000 |
| 730 | NPQNIRVQAS | 2.000 |
| 788 | VMTPAVYAPY | 2.000 |
| 8 | RGLIVYLMFL | 2.000 |
| 406 | NLQPNHTAVY | 2.000 |

V2-HLA-B3501-10mers-(SET 1)-282P1G3
Each peptide is a portion of SEQ ID NO: 5; each start position is specified, the length of peptide is 10 amino acids, and the end position for each peptide is the start position plus nine.

| Start | Subsequence | Score |
|---|---|---|
| 10 | FPKEKIDPLE | 1.200 |
| 7 | VPKFPKEKID | 0.600 |
| 6 | SVPKFPKEKI | 0.400 |
| 4 | VPSVPKFPKE | 0.200 |
| 9 | KFPKEKIDPL | 0.200 |
| 1 | EFIVPSVPKF | 0.100 |
| 3 | IVPSVPKFPK | 0.010 |
| 2 | FIVPSVPKFP | 0.010 |
| 5 | PSVPKFPKEK | 0.005 |
| 8 | PKFPKEKIDP | 0.000 |

V2-HLA-B3501-10mers-(SET 2)-282P1G3
Each peptide is a portion of SEQ ID NO: 5; each start position is specified, the length of peptide is 10 amino acids, and the end position for each peptide is the start position plus nine.

| Start | Subsequence | Score |
|---|---|---|
| 1 | ESSTLGEGKY | 10.000 |
| 4 | TLGEGKYAGL | 2.000 |
| 2 | SSTLGEGKYA | 0.750 |
| 5 | LGEGKYAGLY | 0.600 |
| 8 | GKYAGLYDDI | 0.040 |
| 7 | EGKYAGLYDD | 0.030 |
| 3 | STLGEGKYAG | 0.010 |
| 6 | GEGKYAGLYD | 0.001 |

V2-HLA-B3501-10mers-(SET 3)-282P1G3
Each peptide is a portion of SEQ ID NO: 5; each start position is specified, the length of peptide is 10 amino acids, and the end position for each peptide is the start position plus nine.

| Start | Subsequence | Score |
|---|---|---|
| 2 | ESSTLGEGKY | 10.000 |
| 5 | TLGEGKYAGL | 2.000 |

TABLE XXI-continued

| Start | Subsequence | Score |
|---|---|---|
| 3 | SSTLGEGKYA | 0.750 |
| 6 | LGEGKYAGLY | 0.600 |
| 9 | GKYAGLYDDI | 0.040 |
| 8 | EGKYAGLYDD | 0.030 |
| 10 | KYAGLYDDIS | 0.020 |
| 4 | STLGEGKYAG | 0.010 |
| 7 | GEGKYAGLYD | 0.001 |
| 1 | EESSTLGEGK | 0.001 |

V3-HLA-B3501-10mers-282P1G3
Each peptide is a portion of SEQ ID NO: 7; each start position is specified, the length of peptide is 10 amino acids, and the end position for each peptide is the start position plus nine.

| Start | Subsequence | Score |
|---|---|---|
| 43 | RNRNMLAEDF | 6.000 |
| 4 | HGVDVINTTY | 4.000 |
| 52 | FIQKSTSCNY | 2.000 |
| 26 | SPQPSIFICS | 2.000 |
| 33 | ICSKEQELSY | 2.000 |
| 10 | NTTYVSNTTY | 2.000 |
| 22 | NATGSPQPSI | 1.200 |
| 39 | ELSYRNRNML | 1.000 |
| 59 | CNYVEKSSTF | 1.000 |
| 23 | ATGSPQPSIF | 1.000 |
| 53 | IQKSTSCNYV | 0.600 |
| 14 | VSNTTYVSNA | 0.500 |
| 40 | LSYRNRNMLA | 0.500 |
| 57 | TSCNYVEKSS | 0.500 |
| 25 | GSPQPSIFIC | 0.500 |
| 34 | CSKEQELSYR | 0.450 |
| 24 | TGSPQPSIFI | 0.400 |
| 60 | NYVEKSSTFF | 0.200 |
| 28 | QPSIFICSKE | 0.200 |
| 11 | TTYVSNTTYV | 0.200 |
| 47 | MLAEDFIQKS | 0.200 |
| 38 | QELSYRNRNM | 0.200 |
| 48 | LAEDFIQKST | 0.180 |
| 32 | FICSKEQELS | 0.150 |
| 58 | SCNYVEKSST | 0.150 |
| 2 | VIHGVDVINT | 0.150 |
| 62 | VEKSSTFFKI | 0.120 |
| 9 | INTTYVSNTT | 0.100 |
| 31 | IFICSKEQEL | 0.100 |
| 7 | DVINTTYVSN | 0.100 |
| 13 | YVSNTTYVSN | 0.100 |
| 17 | TTYVSNATGS | 0.100 |
| 21 | SNATGSPQPS | 0.100 |
| 55 | KSTSCNYVEK | 0.100 |
| 56 | STSCNYVEKS | 0.100 |
| 8 | VINTTYVSNT | 0.100 |
| 15 | SNTTYVSNAT | 0.100 |
| 5 | GVDVINTTYV | 0.060 |
| 20 | VSNATGSPQP | 0.050 |
| 44 | NRNMLAEDFI | 0.040 |
| 45 | RNMLAEDFIQ | 0.030 |
| 37 | EQELSYRNRN | 0.030 |
| 46 | NMLAEDFIQK | 0.015 |
| 19 | YVSNATGSPQ | 0.010 |
| 51 | DFIQKSTSCN | 0.010 |
| 1 | PVIHGVDVIN | 0.010 |
| 30 | SIFICSKEQE | 0.010 |
| 16 | NTTYVSNATG | 0.010 |
| 6 | VDVINTTYVS | 0.010 |
| 12 | TYVSNTTYVS | 0.010 |
| 3 | IHGVDVINTT | 0.010 |
| 50 | EDFIQKSTSC | 0.010 |
| 29 | PSIFICSKEQ | 0.005 |
| 36 | KEQELSYRNR | 0.004 |
| 41 | SYRNRNMLAE | 0.003 |
| 49 | AEDFIQKSTS | 0.003 |
| 35 | SKEQELSYRN | 0.003 |
| 61 | YVEKSSTFFK | 0.003 |
| 54 | QKSTSCNYVE | 0.001 |

TABLE XXI-continued

| Start | Subsequence | Score |
|---|---|---|
| 42 | YRNRNMLAED | 0.001 |
| 27 | PQPSIFICSK | 0.001 |
| 18 | TYVSNATGSP | 0.001 |
| | V4-HLA-B35-10mers-282P1G3 Each peptide is a portion of SEQ ID NO: 9; each start position is specified, the length of peptide is 10 amino acids, and the end position for each peptide is the start position plus nine. | |
| 10 | LPEQPTFLKV | 1.200 |
| 1 | SVTLYSGEDL | 1.000 |
| 8 | EDLPEQPTFL | 0.100 |
| 5 | YSGEDLPEQP | 0.100 |
| 6 | SGEDLPEQPT | 0.060 |
| 7 | GEDLPEQPTF | 0.045 |
| 9 | DLPEQPTFLK | 0.020 |
| 3 | TLYSGEDLPE | 0.015 |
| 2 | VTLYSGEDLP | 0.010 |
| 4 | LYSGEDLPEQ | 0.002 |
| | V5-HLA-B35-10mers-282P1G3 Each peptide is a portion of SEQ ID NO: 11; each start position is specified, the length of peptide is 10 amino acids, and the end position for each peptide is the start position plus nine. | |
| 1 | MPMKLTVNSS | 2.000 |
| 4 | KLTVNSSNSI | 0.800 |
| 8 | NSSNSIKQRK | 0.050 |
| 9 | SSNSIKQRKP | 0.050 |
| 2 | PMKLTVNSSN | 0.030 |
| 6 | TVNSSNSIKQ | 0.010 |
| 10 | SNSIKQRKPK | 0.010 |
| 3 | MKLTVNSSNS | 0.010 |
| 7 | VNSSNSIKQR | 0.010 |
| 5 | LTVNSSNSIK | 0.010 |
| | V6-HLA-B35-10mers-282P1G3 Each peptide is a portion of SEQ ID NO: 13; each start position is specified, the length of peptide is 10 amino acids, and the end position for each peptide is the start position plus nine. | |
| 8 | VPKLEHIEQD | 0.600 |
| 2 | EEIEFIVPKL | 0.200 |
| 5 | EFIVPKLEHI | 0.040 |
| 7 | IVPKLEHIEQ | 0.015 |
| 6 | FIVPKLEHIE | 0.010 |
| 10 | KLEHIEQDER | 0.009 |
| 3 | EIEFIVPKLE | 0.003 |
| 4 | IEFIVPKLEH | 0.001 |
| 1 | SEEIEFIVPK | 0.000 |
| 9 | PKLEHIEQDE | 0.000 |
| | V7-HLA-B35-10mers-282P1G3 Each peptide is a portion of SEQ ID NO: 15; each start position is specified, the length of peptide is 10 amino acids, and the end position for each peptide is the start position plus nine. | |
| 10 | DNISHELFTL | 1.500 |
| 17 | FTLHPEPPRW | 0.750 |
| 7 | IVEDNISHEL | 0.600 |
| 18 | TLHPEPPRWT | 0.100 |
| 12 | ISHELFTLHP | 0.100 |
| 20 | HPEPPRWTKK | 0.060 |
| 3 | DFHVIVEDNI | 0.040 |
| 8 | VEDNISHELF | 0.030 |
| 6 | VIVEDNISHE | 0.020 |
| 4 | FHVIVEDNIS | 0.015 |
| 5 | HVIVEDNISH | 0.015 |
| 15 | ELFTLHPEPP | 0.010 |
| 11 | NISHELFTLH | 0.010 |
| 2 | HDFHVIVEDN | 0.010 |
| 9 | EDNISHELFT | 0.010 |
| 19 | LHPEPPRWTK | 0.002 |
| 16 | LFTLHPEPPR | 0.001 |
| 14 | HELFTLHPEP | 0.001 |
| 13 | SHELFTLHPE | 0.000 |
| 1 | THDFHVIVED | 0.000 |
| 21 | PEPPRWTKKP | 0.000 |

Tables XXII–XLIX:

TABLE XXII

| Pos | 123456789 | score |
|---|---|---|
| | HLA-V1-A1-9mers-282P1G3 Each peptide is a portion of SEQ ID NO: 3; each start position is specified, the length of peptide is 9 amino acids, and the end position for each peptide is the start position plus eight. | |
| 1500 | TTEEDAGSY | 31 |
| 1144 | VKDETFGEY | 29 |
| 1078 | VIETRGREY | 27 |
| 173 | HIEQDERVY | 26 |
| 69 | WTKDGNPFY | 24 |
| 755 | EQNGPGLEY | 24 |
| 961 | NLTGYLLQY | 24 |
| 5 | LLGRGLIVY | 23 |
| 579 | GTEDGRIII | 23 |
| 789 | MTPAVYAPY | 23 |
| 816 | VTLYSGEDY | 23 |
| 350 | TKKPQSAVY | 22 |
| 597 | VTLEDQGIY | 22 |
| 903 | EFHLTVLAY | 22 |
| 1154 | DSDEKPLKG | 22 |
| 78 | FTDHRIIPS | 21 |
| 145 | EGDPIVLPC | 21 |
| 120 | SEEIEFIVP | 20 |
| 157 | KGLPPLHIY | 20 |
| 181 | YMSQKGDLY | 20 |
| 236 | STEIGSKAN | 22 |
| 316 | VSYQDKGNY | 20 |
| 1192 | SEDGSFIGA | 20 |
| 44 | QVAFPFDEY | 19 |
| 690 | LPLAPFVRY | 19 |
| 915 | GAGPESEPY | 19 |
| 919 | ESEPYIFQT | 19 |
| 997 | SNLNATTKY | 19 |
| 1119 | VKRNRGGKY | 19 |
| 1175 | ESADSLVEY | 19 |
| 257 | PTESGSESS | 18 |
| 489 | IYENGTLQI | 18 |
| 586 | IIDGANLTI | 18 |
| 598 | TLEDQGIYC | 18 |
| 627 | VPDPPENLH | 18 |
| 811 | PDPQSVTLY | 18 |
| 975 | TYEIGELND | 18 |
| 1021 | ITEESSTLG | 18 |
| 1082 | RGREYAGLY | 18 |
| 1173 | PTESADSLV | 18 |
| 62 | NPEPTFSWT | 17 |

TABLE XXII-continued

| Pos | 123456789 | score |
|---|---|---|
| 99 | HISHFQGKY | 17 |
| 143 | VEEGDPIVL | 17 |
| 310 | TLKIENVSY | 17 |
| 343 | VEEPPRWTK | 17 |
| 434 | VVDVRPLIQ | 17 |
| 476 | VEEVKPLEG | 17 |
| 479 | VKPLEGRRY | 17 |
| 636 | LSERQNRSV | 17 |
| 669 | KEEPGRWEE | 17 |
| 957 | KLNGNLTGY | 17 |
| 1052 | VEEPGAEHI | 17 |
| 1083 | GREYAGLYD | 17 |
| 1129 | VKEKEDLHP | 17 |
| 1191 | FSEDGSFIG | 17 |
| 194 | EEKDSRNDY | 16 |
| 270 | KGEILLLEC | 16 |
| 336 | THDFHVIVE | 16 |
| 371 | EGEPQPTIK | 16 |
| 393 | AGDVVFPRE | 16 |
| 407 | LQPNHTAVY | 16 |
| 441 | IQTKDGENY | 16 |
| 447 | ENYATVVGY | 16 |
| 630 | PPENLHLSE | 16 |
| 786 | LRVMTPAVY | 16 |
| 810 | GPDPQSVTL | 16 |
| 853 | RVHGRLKGY | 16 |
| 878 | PKEVNILRF | 16 |
| 901 | FSEFHLTVL | 16 |
| 944 | DKDTATLSW | 16 |
| 968 | QYQIINDTY | 16 |
| 1022 | TEESSTLGE | 16 |
| 1094 | STQGWFIGL | 16 |
| 1152 | YSDSDEKPL | 16 |
| 49 | FDEYFQIEC | 15 |
| 299 | KGRETKENY | 15 |
| 318 | YQDKGNYRC | 15 |
| 326 | CTASNFLGT | 15 |
| 359 | STGSNGILL | 15 |
| 466 | SPEAVVSWQ | 15 |
| 482 | LEGRRYHIY | 15 |
| 580 | TEDGRIIID | 15 |
| 653 | DHNSNISEY | 15 |
| 658 | ISEYIVEFE | 15 |
| 747 | KWEPLKSME | 15 |
| 932 | PEQPTFLKV | 15 |
| 972 | INDTYEIGE | 15 |
| 1000 | NATTKYKFY | 15 |
| 1183 | YGEGDHGLF | 15 |
| 1193 | EDGSFIGAY | 15 |
| | HLA-V2-(SET1)-A1-9mers-(SET1)-282P1G3 Each peptide is a portion of SEQ ID NO: 5; each start position is specified, the length of peptide is 9 amino acids, and the end position for each peptide is the start position plus eight. | |
| 4 | PSVPKFPKE | 13 |
| 1 | FIVPSVPKF | 8 |
| | HLA-V2-(SET2)-A1-9mers-(SET2)-282P1G3 Each peptide is a portion of SEQ ID NO: 5; each start position is specified, the length of peptide is 9 amino acids, and the end position for each peptide is the start position plus eight. | |
| 5 | KGREAKENY | 15 |
| 9 | AKENYGKTL | 13 |

TABLE XXII-continued

| Pos | 123456789 | score |
|---|---|---|
| 6 | GREAKENYG | 10 |
| | HLA-V2-(SET3)-A1-9mers-(SET3)-282P1G3 Each peptide is a portion of SEQ ID NO: 5; each start position is specified, the length of peptide is 9 amino acids, and the end position for each peptide is the start position plus eight. | |
| 2 | SSTLGEGKY | 25 |
| 6 | GEGKYAGLY | 18 |
| | HLA-V3-A1-9mers-282P1G3 Each peptide is a portion of SEQ ID NO: 7; each start position is specified, the length of peptide is 9 amino acids, and the end position for each peptide is the start position plus eight. | |
| 33 | CSKEQELSY | 27 |
| 4 | GVDVINTTY | 26 |
| 10 | TTYVSNTTY | 22 |
| 52 | IQKSTSCNY | 15 |
| | HLA-V4-A1-9mers-282P1G3 Each peptide is a portion of SEQ ID NO: 9; each start position is specified, the length of peptide is 9 amino acids, and the end position for each peptide is the start position plus eight. | |
| 9 | LPEQPTFLK | 13 |
| 5 | SGEDLPEQP | 12 |
| 6 | GEDLPEQPT | 11 |
| 1 | VTLYSGEDL | 8 |
| 3 | LYSGEDLPE | 7 |
| 4 | YSGEDLPEQ | 6 |
| | HLA-V5-A1-9mers-282P1G3 Each peptide is a portion of SEQ ID NO: 11; each start position is specified, the length of peptide is 9 amino acids, and the end position for each peptide is the start position plus eight. | |
| 6 | VNSSNSIKQ | 7 |
| 4 | LTVNSSNSI | 6 |
| 8 | SSNSIKQRK | 6 |
| 7 | NSSNSIKQR | 4 |
| 9 | SNSIKQRKP | 4 |
| 2 | MKLTVNSSN | 3 |
| | HLA-V6-A1-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 13 |

TABLE XXII-continued

| Pos | 123456789 | score |
|---|---|---|
| 9 | KLEHIEQDE | 11 |
| 4 | EFIVPKLEH | 7 |
| | HLA-V7-A1-9mers-282P1G3 Each peptide is a portion of SEQ ID NO: 15; each start position is specified, the length of peptide is 9 amino acids, and the end position for each peptide is the start position plus eight. | |
| 12 | SHELFTLHP | 18 |
| 19 | HPEPPRWTK | 16 |
| 7 | VEDNISHEL | 11 |
| 6 | IVEDNISHE | 10 |
| 11 | ISHELFTLH | 9 |
| 16 | FTLHPEPPR | 8 |

TABLE XXIII

| Pos | 123456789 | score |
|---|---|---|
| | V1-HLA-A0201-9mers-282P1G3 Each peptide is a portion of SEQ ID NO: 3; each start position is specified, the length of peptide is 9 amino acids, and the end position for each peptide is the start position plus eight. | |
| 1108 | LLTLLLLTV | 29 |
| 9 | GLIVYLMFL | 28 |
| 125 | FIVPSVPKL | 28 |
| 268 | ILKGEILLL | 28 |
| 836 | VINSTLVKV | 28 |
| 1101 | GLMCAIALL | 28 |
| 1111 | LLLLTVCFV | 28 |
| 4 | LLLGRGLIV | 27 |
| 1105 | AIALLTLLL | 26 |
| 688 | VILPLAPFV | 25 |
| 118 | AMSEEIEFI | 24 |
| 426 | ILANANIDV | 24 |
| 785 | TLRVMTPAV | 24 |
| 1107 | ALLTLLLLT | 24 |
| 1159 | PLKGSLRSL | 24 |
| 17 | LLLKFSKAI | 23 |
| 206 | AAFPRLRTI | 23 |
| 275 | LLECFAEGL | 23 |
| 406 | NLQPNHTAV | 23 |
| 586 | IIDGANLTI | 23 |
| 591 | NLTISNVTL | 23 |
| 826 | DTAPVIHGV | 23 |
| 970 | QIINDTYEI | 23 |
| 1106 | IALLTLLLL | 23 |
| 245 | SIKQRKPKL | 22 |
| 267 | TILKGEILL | 22 |
| 584 | RIIIDGANL | 22 |
| 923 | YIFQTPEGV | 22 |
| 1027 | TLGEGSKGI | 22 |
| 6 | LGRGLIVYL | 21 |
| 23 | KAIEIPSSV | 21 |
| 37 | IIKQSKVQV | 21 |
| 163 | HIYWMNIEL | 21 |
| 166 | WMNIELEHI | 21 |
| 219 | PMKLTVNSL | 21 |
| 253 | LLLPPTESG | 21 |
| 427 | LANANIDVV | 21 |
| 429 | NANIDVVDV | 21 |
| 619 | ITQVTVLDV | 21 |
| 753 | SMEQNGPGL | 21 |

TABLE XXIII-continued

| Pos | 123456789 | score |
|---|---|---|
| 942 | KVDKDTATL | 21 |
| 1033 | KGIGKISGV | 21 |
| 1042 | NLTQKTHPI | 21 |
| 1073 | SIFQDVIET | 21 |
| 1104 | CAIALLTLL | 21 |
| 10 | LIVYLMFLL | 20 |
| 13 | YLMFLLLKF | 20 |
| 16 | FLLLKFSKA | 20 |
| 122 | EIEFIVPSV | 20 |
| 210 | RLRTIVQKM | 20 |
| 265 | SITILKGEI | 20 |
| 274 | LLLECFAEG | 20 |
| 335 | ATHDFHVIV | 20 |
| 585 | IIIDGANLT | 20 |
| 589 | GANLTISNV | 20 |
| 616 | AADITQVTV | 20 |
| 793 | VYAPYDVKV | 20 |
| 3 | PLLLGRGLI | 19 |
| 26 | EIPSSVQQV | 19 |
| 266 | ITILKGEIL | 19 |
| 451 | TVVGYSAFL | 19 |
| 471 | VSWQKVEEV | 19 |
| 657 | NISEYIVEF | 19 |
| 680 | RVQGKKTTV | 19 |
| 890 | RNSGMVPSL | 19 |
| 935 | PTFLKVIKV | 19 |
| 949 | TLSWGLPKK | 19 |
| 957 | KLNGNLTGY | 19 |
| 976 | YEIGELNDI | 19 |
| 995 | HLSNLNATT | 19 |
| 1088 | GLYDDISTQ | 19 |
| 1094 | STQGWFIGL | 19 |
| 1103 | MCAIALLTL | 19 |
| 5 | LLGRGLIVY | 18 |
| 11 | IVYLMFLLL | 18 |
| 133 | LPKEKIDPL | 18 |
| 214 | IVQKMPMKL | 18 |
| 292 | KIGGDLPKG | 18 |
| 515 | AIGKTAVTA | 18 |
| 617 | ADITQVTVL | 18 |
| 673 | GRWEELTRV | 18 |
| 700 | FRVIAVNEV | 18 |
| 743 | EMIIKWEPL | 18 |
| 840 | TLVKVTWST | 18 |
| 900 | AFSEFHLTV | 18 |
| 953 | GLPKKLNGN | 18 |
| 1020 | PITEESSTL | 18 |
| 1136 | HPDPEIQSV | 18 |
| 29 | SSVQQVPTI | 17 |
| 154 | NPPKGLPPL | 17 |
| 238 | EIGSKANSI | 17 |
| 333 | GTATHDFHV | 17 |
| 424 | GTILANANI | 17 |
| 444 | KDGENYATV | 17 |
| 481 | PLEGRRYHI | 17 |
| 514 | NAIGKTAVT | 17 |
| 537 | PKNPRIPKL | 17 |
| 540 | PRIPKLHML | 17 |
| 558 | SHLKHSLKL | 17 |
| 611 | TALDSAADI | 17 |
| 810 | GPDPQSVTL | 17 |
| 829 | PVIHGVDVI | 17 |
| 833 | GVDVINSTL | 17 |
| 841 | LVKVTWSTV | 17 |
| 863 | INWWKTKSL | 17 |
| 870 | SLLDGRTHP | 17 |
| 871 | LLDGRTHPK | 17 |
| 875 | RTHPKEVNI | 17 |
| 930 | GVPEQPTFL | 17 |
| 946 | DTATLSWGL | 17 |
| 950 | LSWGLPKKL | 17 |
| 961 | NLTGYLLQY | 17 |
| 1055 | PGAEHIVRL | 17 |
| 1110 | TLLLLTVCF | 17 |
| 1121 | RNRGGKYSV | 17 |

TABLE XXIII-continued

| Pos | 123456789 | score |
|---|---|---|
| 1163 | SLRSLNRDM | 17 |
| 1166 | SLNRDMQPT | 17 |
| 35 | PTIIKQSKV | 16 |
| 137 | KIDPLEVEE | 16 |
| 161 | PLHIYWMNI | 16 |
| 216 | QKMPMKLTV | 16 |
| 252 | KLLLPPTES | 16 |
| 280 | AEGLPTPQV | 16 |
| 359 | STGSNGILL | 16 |
| 366 | LLCEAEGEP | 16 |
| 370 | AEGEPQPTI | 16 |
| 432 | IDVVDVRPL | 16 |
| 463 | FFASPEAVV | 16 |
| 525 | LDIRNATKL | 16 |
| 534 | RVSPKNPRI | 16 |
| 603 | GIYCCSAHT | 16 |
| 608 | SAHTALDSA | 16 |
| 612 | ALDSAADIT | 16 |
| 691 | PLAPFVRYQ | 16 |
| 780 | TVTNHTLRV | 16 |
| 788 | VMTPAVYAP | 16 |
| 799 | VKVQAINQL | 16 |
| 893 | GMVPSLDAF | 16 |
| 908 | VLAYNSKGA | 16 |
| 1001 | ATTKYKFYL | 16 |
| 1179 | SLVEYGEGD | 16 |
| 14 | LMFLLLKFS | 15 |
| 82 | RIIPSNNSG | 15 |
| 83 | IIPSNNSGT | 15 |
| 86 | SNNSGTFRI | 15 |
| 142 | EVEEGDPIV | 15 |
| 254 | LLPPTESGS | 15 |
| 273 | ILLLECFAE | 15 |
| 308 | GKTLKIENV | 15 |
| 327 | TASNFLGTA | 15 |
| 349 | WTKKPQSAV | 15 |
| 364 | GILLCEAEG | 15 |
| 365 | ILLCEAEGE | 15 |
| 474 | QKVEEVKPL | 15 |
| 487 | YHIYENGTL | 15 |
| 546 | HMLELHCES | 15 |
| 579 | GTEDGRIII | 15 |
| 614 | DSAADITQV | 15 |
| 615 | SAADITQVT | 15 |
| 626 | DVPDPPENL | 15 |
| 684 | KKTTVILPL | 15 |
| 746 | IKWEPLKSM | 15 |
| 808 | GSGPDPQSV | 15 |
| 876 | THPKEVNIL | 15 |
| 926 | QTPEGVPEQ | 15 |
| 958 | LNGNLTGYL | 15 |
| 965 | YLLQYQIIN | 15 |
| 966 | LLQYQIIND | 15 |
| 980 | ELNDINITT | 15 |
| 991 | KPSWHLSNL | 15 |
| 1092 | DISTQGWFI | 15 |
| 1099 | FIGLMCAIA | 15 |
| 1100 | IGLMCAIAL | 15 |
| 1102 | LMCAIALLT | 15 |
| 1113 | LLTVCFVKR | 15 |
| 19 | LKFSKAIEI | 14 |
| 30 | SVQQVPTII | 14 |
| 107 | YRCFASNKL | 14 |
| 110 | FASNKLGIA | 14 |
| 115 | LGIAMSEEI | 14 |
| 150 | VLPCNPPKG | 14 |
| 158 | GLPPLHIYW | 14 |
| 185 | KGDLYFANV | 14 |
| 217 | KMPMKLTVN | 14 |
| 260 | SGSESSITI | 14 |
| 261 | GSESSITIL | 14 |
| 282 | GLPTPQVDW | 14 |
| 305 | ENYGKTLKI | 14 |
| 331 | FLGTATHDF | 14 |
| 489 | IYENGTLQI | 14 |
| 504 | DAGSYSCWV | 14 |
| 517 | GKTAVTANL | 14 |

TABLE XXIII-continued

| Pos | 123456789 | score |
|---|---|---|
| 524 | NLDIRNATK | 14 |
| 527 | IRNATKLRV | 14 |
| 542 | IPKLHMLEL | 14 |
| 556 | CDSHLKHSL | 14 |
| 569 | SKDGEAFEI | 14 |
| 697 | RYQFRVIAV | 14 |
| 702 | VIAVNEVGR | 14 |
| 757 | NGPGLEYRV | 14 |
| 781 | VTNHTLRVM | 14 |
| 822 | EDYPDTAPV | 14 |
| 828 | APVIHGVDV | 14 |
| 940 | VIKVDKDTA | 14 |
| 973 | NDTYEIGEL | 14 |
| 1008 | YLRACTSQG | 14 |
| 1036 | GKISGVNLT | 14 |
| 1037 | KISGVNLTQ | 14 |
| 1053 | FEPGAEHIV | 14 |
| 1066 | KNWGDNDSI | 14 |
| 1098 | WFIGLMCAI | 14 |
| 1112 | LLLTVCFVK | 14 |
| 1189 | GLFSEDGSF | 14 |
| 1202 | AGSKEKGSV | 14 |
| 1216 | STATFPLRA | 14 |
| | V2-(SET1)-HLA-A0201-9mers-(SET1)-282P1G3 Each peptide is a portion of SEQ ID NO: 5; each start position is specified, the length of peptide is 9 amino acids, and the end position for each peptide is the start position plus eight. | |
| 1 | FIVPSVPKF | 18 |
| 9 | FPKEKIDPL | 17 |
| 6 | VPKFPKEKI | 10 |
| 5 | SVPKFPKEK | 8 |
| | V2-(SET2)-HLA-A0201-9mers-282P1G3 Each peptide is a portion of SEQ ID NO: 5; each start position is specified, the length of peptide is 9 amino acids, and the end position for each peptide is the start position plus eight. | |
| 9 | AKENYGKTL | 13 |
| 1 | GDLPKGREA | 12 |
| 2 | DLPKGREAK | 12 |
| 8 | EAKENYGKT | 8 |
| 3 | LPKGREAKE | 7 |
| | V2-(SET3)-HLA-A0201-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 17 |
| 4 | TLGEGKYAG | 16 |
| 9 | KYAGLYDDI | 14 |
| 3 | STLGEGKYA | 13 |
| 8 | GKYAGLYDD | 9 |
| | V3-HLA-A0201-9mers-282P1G3 Each peptide is a portion of SEQ ID NO: 7; each | |

TABLE XXIII-continued

| Pos | 123456789 | score |
|---|---|---|
| | start position is specified, the length of peptide is 9 amino acids, and the end position for each peptide is the start position plus eight. | |
| 31 | FICSKEQEL | 22 |
| 22 | ATGSPQPSI | 18 |
| 7 | VINTTYVSN | 14 |
| 39 | LSYRNRNML | 14 |
| 46 | MLAEDFIQK | 14 |
| 1 | VIHGVDVIN | 13 |
| 5 | VDVINTTYV | 13 |
| 47 | LAEDFIQKS | 13 |
| 3 | HGVDVINTT | 12 |
| 11 | TYVSNTTYV | 12 |
| 29 | SIFICSKEQ | 12 |
| 51 | FIQKSTSCN | 11 |
| 53 | QKSTSCNYV | 11 |
| 2 | IHGVDVINT | 10 |
| 8 | INTTYVSNT | 10 |
| 14 | SNTTYVSNA | 10 |
| 18 | YVSNATGSP | 10 |
| 24 | GSPQPSIFI | 10 |
| 38 | ELSYRNRNM | 10 |
| 45 | NMLAEDFIQ | 10 |
| 55 | STSCNYVEK | 10 |
| | V4-HLA-A0201-9mers-282P1G3 Each peptide is a portion of SEQ ID NO: 9; each start position is specified, the length of peptide is 9 amino acids, and the end position for each peptide is the start position plus eight. | |
| 8 | DLPEQPTFL | 21 |
| 1 | VTLYSGEDL | 16 |
| 2 | TLYSGEDLP | 13 |
| 4 | YSGEDLPEQ | 11 |
| | V5-HLA-A0201-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 17 |
| 1 | PMKLTVNSS | 11 |
| 3 | KLTVNSSNS | 10 |
| | V6-HLA-A0201-9mers-282P1G3 Each peptide is a portion of SEQ ID NO: 13; each start position is specified, the length of peptide is 9 amino acids, and the end position for each peptide is the start position plus eight. | |
| 5 | FIVPKLEHI | 24 |
| 2 | EIEFIVPKL | 20 |
| | V7-HLA-A0201-9mers-282P1G3 Each peptide is a portion of SEQ ID NO: 15; each start position is specified, | |

TABLE XXIII-continued

| Pos | 123456789 | score |
|---|---|---|
| | the length of peptide is 9 amino acids, and the end position for each peptide is the start position plus eight. | |
| 10 | NISHELFTL | 24 |
| 7 | VEDNISHEL | 14 |
| 5 | VIVEDNISH | 13 |
| 17 | TLHPEPPRW | 13 |
| 14 | ELFTLHPEP | 12 |

TABLE XXIV

| Pos | 123456789 | score |
|---|---|---|
| | V1-HLA-A0203-9mers-282P1G3 | |
| | NoResultsFound. | |
| | V2-(SET1)-HLA-A0203-9mers-282P1G3 | |
| | NoResultsFound. | |
| | V2-(SET2)-HLA-A0203-9mers-282P1G3 | |
| | NoResultsFound. | |
| | V2-(SET3)-HLA-A0203-9mers-282P1G3 | |
| | NoResultsFound. | |
| | V3-HLA-A0203-9mers-282P1G3 | |
| | NoResultsFound. | |
| | V4-HLA-A0203-9mers-(SET2)-282P1G3 | |
| | NoResultsFound. | |
| | V5-HLA-A0203-9mers-(SET2)-282P1G3 | |
| | NoResultsFound. | |
| | V6-HLA-A0203-9mers-(SET2)-282P1G3 | |
| | NoResultsFound. | |
| | V7-HLA-A0203-9mers-(SET2)-282P1G3 | |
| | NoResultsFound. | |

TABLE XXV

| Pos | 123456789 | score |
|---|---|---|
| | V1-HLA-A3-9mers-282P1G3 Each peptide is a portion of SEQ ID NO: 3; each start position is specified, the length of peptide is 9 | |

TABLE XXV-continued

| Pos | 123456789 | score |
|---|---|---|
| | amino acids, and the end position for each peptide is the start position plus eight. | |
| 792 | AVYAPYDVK | 33 |
| 835 | DVINSTLVK | 31 |
| 436 | DVRPLIQTK | 30 |
| 524 | NLDIRNATK | 30 |
| 149 | IVLPCNPPK | 27 |
| 296 | DLPKGRETK | 27 |
| 843 | KVTWSTVPK | 27 |
| 1112 | LLLTVCFVK | 27 |
| 1118 | FVKRNRGGK | 26 |
| 1197 | FIGAYAGSK | 26 |
| 5 | LLGRGLIVY | 25 |
| 677 | ELTRVQGKK | 25 |
| 937 | FLKVIKVDK | 25 |
| 310 | TLKIENVSY | 24 |
| 701 | RVIAVNEVG | 24 |
| 760 | GLEYRVTWK | 24 |
| 853 | RVHGRLKGY | 24 |
| 871 | LLDGRTHPK | 24 |
| 961 | NLTGYLLQY | 24 |
| 356 | AVYSTGSNG | 23 |
| 547 | MLELHCESK | 23 |
| 4 | LLLGRGLIV | 22 |
| 106 | KYRCFASNK | 22 |
| 129 | SVPKLPKEK | 22 |
| 209 | PRLRTIVQK | 22 |
| 413 | AVYQCEASN | 22 |
| 515 | AIGKTAVTA | 22 |
| 584 | RIIIDGANL | 22 |
| 680 | RVQGKKTTV | 22 |
| 689 | ILPLAPFVR | 22 |
| 949 | TLSWGLPKK | 22 |
| 957 | KLNGNLTGY | 22 |
| 998 | NLNATTKYK | 22 |
| 1088 | GLYDDISTQ | 22 |
| 381 | RVNGSPVDN | 21 |
| 396 | VVEPREISF | 21 |
| 687 | TVILPLAPF | 21 |
| 744 | MIIKWEPLK | 21 |
| 787 | RVMTPAVYA | 21 |
| 882 | NILRFSGQR | 21 |
| 948 | ATLSWGLPK | 21 |
| 983 | DINITTPSK | 21 |
| 1008 | YLRACTSQG | 21 |
| 1037 | KISGVNLTQ | 21 |
| 1051 | EVEEPGAEH | 21 |
| 1110 | TLLLLTVCF | 21 |
| 11 | IVYLMFLLL | 20 |
| 82 | RIIPSNNSG | 20 |
| 213 | TIVQKMPMK | 20 |
| 221 | KLTVNSLKH | 20 |
| 291 | NKIGGDLPK | 20 |
| 530 | ATKLRVSPK | 20 |
| 661 | YIVEFEGNK | 20 |
| 704 | AVNEVGRSQ | 20 |
| 733 | NIRVQASQP | 20 |
| 942 | KVDKDTATL | 20 |
| 1058 | EHIVRLMTK | 20 |
| 1122 | NRGGKYSVK | 20 |
| 24 | AIEIPSSVQ | 19 |
| 44 | QVAFPFDEY | 19 |
| 177 | DERVYMSQK | 19 |
| 478 | EVKPLEGRR | 19 |
| 520 | AVTANLDIR | 19 |
| 585 | IIIDGANLT | 19 |
| 586 | IIDGANLTI | 19 |
| 591 | NLTISNVTL | 19 |
| 645 | RLTWEAGAD | 19 |
| 829 | PVIHGVDVI | 19 |
| 851 | KDRVHGRLK | 19 |
| 996 | LSNLNATTK | 19 |
| 1040 | GVNLTQKTH | 19 |
| 1078 | VIETRGREY | 19 |

TABLE XXV-continued

| Pos | 123456789 | score |
|---|---|---|
| 1209 | SVESNGSST | 19 |
| 37 | IIKQSKVQV | 18 |
| 137 | KIDPLEVEE | 18 |
| 173 | HIEQDERVY | 18 |
| 179 | RVYMSQKGD | 18 |
| 187 | DLYFANVEE | 18 |
| 252 | KLLLPPTES | 18 |
| 268 | ILKGEILLL | 18 |
| 343 | VEEPPRWTK | 18 |
| 534 | RVSPKNPRI | 18 |
| 841 | LVKVTWSTV | 18 |
| 859 | KGYQINWWK | 18 |
| 861 | YQINWWKTK | 18 |
| 870 | SLLDGRTHP | 18 |
| 883 | ILRFSGQRN | 18 |
| 995 | HLSNLNATT | 18 |
| 1082 | RGREYAGLY | 18 |
| 1107 | ALLTLLLLT | 18 |
| 1108 | LLTLLLLTV | 18 |
| 1113 | LLTVCFVKR | 18 |
| 1128 | SVKEKEDLH | 18 |
| 1137 | PDPEIQSVK | 18 |
| 1199 | GAYAGSKEK | 18 |
| 3 | PLLLGRGLI | 17 |
| 13 | YLMFLLLKF | 17 |
| 16 | FLLLKFSKA | 17 |
| 114 | KLGIAMSEE | 17 |
| 124 | EFIVPSVPK | 17 |
| 210 | RLRTIVQKM | 17 |
| 253 | LLLPPTESG | 17 |
| 340 | HVIVEEPPR | 17 |
| 350 | TKKPQSAVY | 17 |
| 365 | ILLCEAEGE | 17 |
| 452 | VVGYSAFLH | 17 |
| 469 | AVVSWQKVE | 17 |
| 488 | HIYENGTLQ | 17 |
| 494 | TLQINRTTE | 17 |
| 532 | KLRVSPKNP | 17 |
| 657 | NISEYIVEF | 17 |
| 695 | FVRYQFRVI | 17 |
| 702 | VIAVNEVGR | 17 |
| 803 | AINQLGSGP | 17 |
| 833 | GVDVINSTL | 17 |
| 857 | RLKGYQINW | 17 |
| 869 | KSLLDGRTH | 17 |
| 897 | SLDAFSEFH | 17 |
| 907 | TVLAYNSKG | 17 |
| 939 | KVIKVDKDT | 17 |
| 1006 | KFYLRACTS | 17 |
| 1025 | SSTLGEGSK | 17 |
| 1180 | LVEYGEGDH | 17 |
| 1189 | GLFSEDGSF | 17 |
| 8 | RGLIVYLMF | 16 |
| 93 | RIPNEGHIS | 16 |
| 220 | MKLTVNSLK | 16 |
| 254 | LLPPTESGS | 16 |
| 273 | ILLLECFAE | 16 |
| 274 | LLLECFAEG | 16 |
| 304 | KENYGKTLK | 16 |
| 312 | KIENVSYQD | 16 |
| 344 | EEPPRWTKK | 16 |
| 390 | HPFAGDVVF | 16 |
| 421 | NVHGTILAN | 16 |
| 430 | ANIDVVDVR | 16 |
| 434 | VVDVRPLIQ | 16 |
| 447 | ENYATVVGY | 16 |
| 472 | SWQKVEEVK | 16 |
| 526 | DIRNATKLR | 16 |
| 544 | KLHMLELHC | 16 |
| 563 | SLKLSWSKD | 16 |
| 612 | ALDSAADIT | 16 |
| 621 | QVTVLDVPD | 16 |
| 637 | SERQNRSVR | 16 |
| 643 | SVRLTWEAG | 16 |
| 688 | VILPLAPFV | 16 |
| 735 | RVQASQPKE | 16 |
| 764 | RVTWKPQGA | 16 |

TABLE XXV-continued

| Pos | 123456789 | score |
|---|---|---|
| 795 | APYDVKVQA | 16 |
| 817 | TLYSGEDYP | 16 |
| 934 | QPTFLKVIK | 16 |
| 1011 | ACTSQGCGK | 16 |
| 1020 | PITEESSTL | 16 |
| 1038 | ISGVNLTQK | 16 |
| 1060 | IVRLMTKNW | 16 |
| 1077 | DVIETRGRE | 16 |
| 1105 | AIALLTLLL | 16 |
| 1119 | VKRNRGGKY | 16 |
| | V2-(SET1) HLA-A3-9mers-282P1G3 Each peptide is a portion of SEQ ID NO: 5; each start position is specified, the length of peptide is 9 amino acids, and the end position for each peptide is the start position plus eight. | |
| 5 | SVPKFPKEK | 22 |
| 1 | FIVPSVPKF | 15 |
| 2 | IVPSVPKFP | 14 |
| 3 | VPSVPKFPK | 10 |
| | V2-(SET2)-HLA-A3-9mers-282P1G3 Each peptide is a portion of SEQ ID NO: 5; each start position is specified, the length of peptide is 9 amino acids, and the end position for each peptide is the start position plus Eight. | |
| 2 | DLPKGREAK | 24 |
| 7 | REAKENYGK | 15 |
| 5 | KGREAKENY | 13 |
| 9 | AKENYGKTL | 11 |
| | V2-(SET3)-HLA-A3-9mers-282P1G3 Each peptide is a portion of SEQ ID NO: 5; each start position is specified, the length of peptide is 9 amino acids, and the end position for each peptide is the start position plus eight. | |
| 4 | TLGEGKYAG | 14 |
| 1 | ESSTLGEGK | 13 |
| 2 | SSTLGEGKY | 11 |
| 6 | GEGKYAGLY | 10 |
| 3 | STLGEGKYA | 8 |
| 8 | GKYAGLYDD | 8 |
| 7 | EGKYAGLYD | 7 |
| 5 | LGEGKYAGL | 6 |
| 9 | KYAGLYDDI | 6 |
| | V3-HLA-A3-9mers-282P1G3 Each peptide is a portion of SEQ ID NO: 7; each start position is specified, the length of peptide is 9 amino acids, and the end position for each peptide is the start position plus eight. | |
| 46 | MLAEDFIQK | 25 |
| 4 | GVDVINTTY | 21 |
| 6 | DVINTTYVS | 18 |
| 1 | VIHGVDVIN | 15 |
| 10 | TTYVSNTTY | 15 |

TABLE XXV-continued

| Pos | 123456789 | score |
|---|---|---|
| 12 | YVSNTTYVS | 15 |
| 27 | QPSIFICSK | 15 |
| 55 | STSCNYVEK | 15 |
| 60 | YVEKSSTFF | 15 |
| 7 | VINTTYVSN | 14 |
| 18 | YVSNATGSP | 14 |
| 33 | CSKEQELSY | 13 |
| 59 | NYVEKSSTF | 13 |
| 38 | ELSYRNRNM | 12 |
| | V4-HLA-A3-9mers-282P1G3 Each peptide is a portion of SEQ ID NO: 9; each start position is specified, the length of peptide is 9 amino acids, and the end position for each peptide is the start position plus eight. | |
| 2 | TLYSGEDLP | 16 |
| 7 | EDLPEQPTF | 13 |
| 8 | DLPEQPTFL | 13 |
| 9 | LPEQPTFLK | 10 |
| | V5-HLA-A3-9mers-282P1G3 Each peptide is a portion of SEQ ID NO: 11; each start position is specified, the length of peptide is 9 amino acids, and the end position for each peptide is the start position plus eight. | |
| 5 | TVNSSNSIK | 23 |
| 3 | KLTVNSSNS | 16 |
| 8 | SSNSIKQRK | 11 |
| | V6-HLA-A3-9mers-282P1G3 Each peptide is a portion of SEQ ID NO: 13; each start position is specified, the length of peptide is 9 amino acids, and the end position for each peptide is the start position plus eight. | |
| 1 | EEIEFIVPK | 18 |
| 9 | KLEHIEQDE | 13 |
| 5 | FIVPKLEHI | 12 |
| 6 | IVPKLEHIE | 12 |
| 4 | EFIVPKLEH | 10 |
| 2 | EIEFIVPKL | 8 |
| | V7-HLA-A3-9mers-282P1G3 Each peptide is a portion of SEQ ID NO: 15; each start position is specified, the length of peptide is 9 amion acids, and the end position for each peptide is the start position plus eight. | |
| 19 | HPEPPRWTK | 18 |
| 6 | IVEDNISHE | 16 |
| 20 | PEPPRWTKK | 16 |
| 5 | VIVEDNISH | 15 |
| 17 | TLHPEPPRW | 14 |
| 4 | HVIVEDNIS | 13 |
| 10 | NISHELFTL | 12 |
| 14 | ELFTLHPEP | 10 |
| 11 | ISHELFTLH | 8 |
| | | 27 |

TABLE XXV-continued

| Pos | 123456789 | score |
|---|---|---|
| 903 | EFHLTVLAY | 26 |
| 396 | VVFPREISF | 25 |
| 436 | DVRPLIQTK | 25 |
| 653 | DHNSNISEY | 25 |
| 946 | DTATLSWGL | 25 |
| 1077 | DVIETRGRE | 25 |
| 1175 | ESADSLVEY | 25 |
| 447 | ENYATVVGY | 24 |
| 853 | RVHGRLKGY | 24 |
| 929 | EGVPEQPTF | 24 |
| 302 | ETKENYGKT | 23 |
| 433 | DVVDVRPLI | 23 |
| 451 | TVVGYSAFL | 23 |
| 478 | EVKPLEGRR | 23 |
| 500 | TTEEDAGSY | 23 |
| 743 | EMIIKWEPL | 23 |
| 779 | ETVTNHTLR | 23 |
| 835 | DVINSTLVK | 23 |
| 1147 | ETFGEYSDS | 23 |
| 125 | FIVPSVPKL | 22 |
| 142 | EVEEGDPIV | 22 |
| 266 | ITILKGEIL | 22 |
| 395 | DVVFPREIS | 22 |
| 450 | ATVVGYSAF | 22 |
| 755 | EQNGPGLEY | 22 |
| 833 | GVDVINSTL | 22 |
| 880 | EVNILRFSG | 22 |
| 1091 | DDISTQGWF | 22 |
| 122 | EIEFIVPSV | 21 |
| 194 | EEKDSRNDY | 21 |
| 359 | STGSNGILL | 21 |
| 597 | VTLEDQGIY | 21 |
| 707 | EVGRSQPSQ | 21 |
| 826 | DTAPVIHGV | 21 |
| 974 | DTYEIGELN | 21 |
| 2 | EPLLLGRGL | 20 |
| 26 | EIPSSVQQV | 20 |
| 44 | QVAFPFDEY | 20 |
| 121 | EEIEFIVPS | 20 |
| 289 | DWNKIGGDL | 20 |
| 573 | EAFEINGTE | 20 |
| 778 | EETVTNHTL | 20 |
| 930 | GVPEQPTFL | 20 |
| 1156 | DEKPLKGSL | 20 |
| 1182 | EYGEGDHGL | 20 |
| 11 | IVYLMFLLL | 19 |
| 69 | WTKDGNPFY | 19 |
| 136 | EKIDPLEVE | 19 |
| 214 | IVQKMPMKL | 19 |
| 540 | PRIPKLHML | 19 |
| 721 | ETPPAAPDR | 19 |
| 798 | DVKVQAINQ | 19 |
| 816 | VTLYSGEDY | 19 |
| 935 | PTFLKVIKV | 19 |
| 942 | KVDKDTATL | 19 |
| 1058 | EHIVRLMTK | 19 |
| 1080 | ETRGREYAG | 19 |
| 145 | EGDPIVLPC | 18 |
| 474 | QKVEEVKPL | 18 |
| 477 | EEVKPLEGR | 18 |
| 592 | LTISNVTLE | 18 |
| 638 | ERQNRSVRL | 18 |
| 657 | NISEYIVEF | 18 |
| 670 | EEPGRWEEL | 18 |
| 789 | MTPAVYAPY | 18 |
| 829 | PVIHGVDVI | 18 |
| 893 | GMVPSLDAF | 18 |
| 1094 | STQGWFIGL | 18 |
| 10 | LIVYLMFLL | 17 |
| 33 | QVPTIIKQS | 17 |
| 175 | EQDERVYMS | 17 |
| 238 | EIGSKANSI | 17 |
| 271 | GEILLLECF | 17 |
| 581 | EDGRIIIDG | 17 |
| 584 | RIIIDGANL | 17 |
| 799 | VKVQAINQL | 17 |
| 961 | NLTGYLLQY | 17 |
| 977 | EIGELNDIN | 17 |
| 1001 | ATTKYKFYL | 17 |
| 1020 | PITEESSTL | 17 |
| 1104 | CAIALLTLL | 17 |
| 9 | GLIVYLMFL | 16 |
| 51 | EYFQIECEA | 16 |
| 99 | HISHFQGKY | 16 |
| 172 | EHIEQDERV | 16 |
| 197 | DSRNDYCCF | 16 |
| 222 | LTVNSLKHA | 16 |
| 263 | ESSITILKG | 16 |
| 277 | ECFAEGLPT | 16 |
| 314 | ENVSYQDKG | 16 |
| 401 | EISFTNLQP | 16 |
| 421 | NVHGTILAN | 16 |
| 432 | IDVVDVRPL | 16 |
| 511 | WVENAIGKT | 16 |
| 520 | AVTANLDIR | 16 |
| 617 | ADITQVTVL | 16 |
| 622 | VTVLDVPDP | 16 |
| 686 | TTVILPLAP | 16 |
| 919 | ESEPYIFQT | 16 |
| 1023 | EESSTLGEG | 16 |
| 1030 | EGSKGIGKI | 16 |
| 1114 | LTVCFVKRN | 16 |
| 1209 | SVESNGSST | 16 |
| 5 | LLGRGLIVY | 15 |
| 13 | YLMFLLLKF | 15 |
| 35 | PTIIKQSKV | 15 |
| 133 | LPKEKIDPL | 15 |
| 144 | EEGDPIVLP | 15 |
| 157 | KGLPPLHIY | 15 |
| 178 | ERVYMSQKG | 15 |
| 272 | EILLLECFA | 15 |
| 373 | EPQPTIKWR | 15 |
| 462 | EFFASPEAV | 15 |
| 468 | EAVVSWQKV | 15 |
| 469 | AVVSWQKVE | 15 |
| 629 | DPPENLHLS | 15 |
| 685 | KTTVILPLA | 15 |
| 847 | STVPKDRVH | 15 |
| 957 | KLNGNLTGY | 15 |
| 980 | ELNDINITT | 15 |
| 1078 | VIETRGREY | 15 |
| 1140 | EIQSVKDET | 15 |
| 1185 | EGDHGLFSE | 15 |
| 1189 | GLFSEDGSF | 15 |
| 90 | GTFRIPNEG | 14 |
| 124 | EFIVPSVPK | 14 |
| 173 | HIEQDERVY | 14 |
| 192 | NVEEKDSRN | 14 |
| 223 | TVNSLKHAN | 14 |
| 245 | SIKQRKPKL | 14 |
| 267 | TILKGEILL | 14 |
| 338 | DFHVIVEEP | 14 |
| 340 | HVIVEEPPR | 14 |
| 487 | YHIYENGTL | 14 |
| 525 | LDIRNATKL | 14 |
| 537 | PKNPRIPKL | 14 |
| 576 | EINGTEDGR | 14 |
| 582 | DGRIIIDGA | 14 |
| 660 | EYIVEFEGN | 14 |
| 676 | EELTRVQGK | 14 |
| 684 | KKTTVILPL | 14 |
| 701 | RVIAVNEVG | 14 |
| 704 | AVNEVGRSQ | 14 |
| 786 | LRVMTPAVY | 14 |
| 811 | PDPQSVTLY | 14 |
| 839 | STLVKVTWS | 14 |
| 844 | VTWSTVPKD | 14 |
| 852 | DRVHGRLKG | 14 |
| 867 | KTKSLLDGR | 14 |
| 878 | PKEVNILRF | 14 |
| 926 | QTPEGVPEQ | 14 |
| 933 | EQPTFLKVI | 14 |
| 939 | KVIKVDKDT | 14 |
| 973 | NDTYEIGEL | 14 |

TABLE XXV-continued

| Pos | 123456789 | score |
|---|---|---|
| 1055 | PGAEHIVRL | 14 |
| 1073 | SIFQDVIET | 14 |
| 1103 | MCAIALLTL | 14 |
| 1105 | AIALLTLLL | 14 |
| 1128 | SVKEKEDLH | 14 |
| 6 | LGRGLIVYL | 13 |
| 41 | SKVQVAFPF | 13 |
| 45 | VAFPFDEYF | 13 |
| 65 | PTFSWTKDG | 13 |
| 78 | FTDHRIIPS | 13 |
| 95 | PNEGHISHF | 13 |
| 147 | DPIVLPCNP | 13 |
| 163 | HIYWMNIEL | 13 |
| 219 | PMKLTVNSL | 13 |
| 261 | GSESSITIL | 13 |
| 268 | ILKGEILLL | 13 |
| 305 | ENYGKTLKI | 13 |
| 356 | AVYSTGSNG | 13 |
| 456 | SAFLHCEFF | 13 |
| 530 | ATKLRVSPK | 13 |
| 614 | DSAADITQV | 13 |
| 618 | DITQVTVLD | 13 |
| 619 | ITQVTVLDV | 13 |
| 677 | ELTRVQGKK | 13 |
| 775 | EWEEETVTN | 13 |
| 780 | TVTNHTLRV | 13 |
| 815 | SVTLYSGED | 13 |
| 876 | THPKEVNIL | 13 |
| 890 | RNSGMVPSL | 13 |
| 899 | DAFSEFHLT | 13 |
| 906 | LTVLAYNSK | 13 |
| 907 | TVLAYNSKG | 13 |
| 962 | LTGYLLQYQ | 13 |
| 968 | QYQIINDTY | 13 |
| 983 | DINITTPSK | 13 |
| 991 | KPSWHLSNL | 13 |
| 1045 | QKTHPIEVF | 13 |
| 1082 | RGREYAGLY | 13 |
| 1092 | DISTQGWFI | 13 |
| 1106 | IALLTLLLL | 13 |
| 1109 | LTLLLLTVC | 13 |
| 1119 | VKRNRGGKY | 13 |
| 1144 | VKDETFGEY | 13 |
| 1154 | DSDEKPLKG | 13 |
| 1157 | EKPLKGSLR | 13 |
| 1159 | PLKGSLRSL | 13 |

TABLE XXVI

| pos | 123456789 | score |
|---|---|---|
| | VI-HLA-A26-9mers-282P1G3 Each peptide is a portion of SEQ ID NO: 3; each start position is specified, the length of peptide is 9 amino acids, and the end position for each peptide is the start position plus eight. | |
| 626 | DVPDPPENL | 27 |
| 687 | TVILPLAPF | 27 |
| 1051 | EVFEPGAEH | 27 |
| 119 | EDGSFIGAY | 27 |
| | V2-(SET1)-HLA-A26-9mers-(SET1)-282P1G3 Each peptide is a portion of SEQ ID NO: 5; each start position is specified, the length of peptide is 9 amino acids, and the end position for each peptide is the start position plus eight. | |

TABLE XXVI-continued

| pos | 123456789 | score |
|---|---|---|
| 1 | FIVPSVPKF | 22 |
| 9 | FPKEKIDPL | 15 |
| 2 | IVPSVPKFP | 11 |
| 5 | SVPKFPKEK | 11 |
| | V2-(SET2)-HLA-A26-9mers-282P1G3 Each peptide is a portion of SEQ ID NO: 5; each start position is specified, the length of peptide is 9 amino acids, and the end position for each peptide is the start position plus eight. | |
| 8 | EAKENYGKT | 15 |
| 5 | KGREAKENY | 12 |
| 9 | AKENYGKTL | 10 |
| 2 | DLPKGREAK | 9 |
| | V2-(SET3)-HLA-A26-9mers-282P1G3 Each peptide is a portion of SEQ ID NO: 5; each start position is specified, the length of peptide is 9 amino acids, and the end position for each peptide is the start position plus eight. | |
| 2 | SSTLGEGKY | 14 |
| 1 | ESSTLGEGK | 12 |
| 7 | EGKYAGLYD | 12 |
| 6 | GEGKYAGLY | 11 |
| 3 | STLGEGKYA | 10 |
| 5 | LGEGKYAGL | 9 |
| | V3-HLA-A26-9mers-282P1G3 Each peptide is a portion of SEQ ID NO: 7; each start position is specified, the length of peptide is 9 amino acids, and the end position for each peptide is the start position plus eight. | |
| 4 | GVDVINTTY | 23 |
| 6 | DVINTTYVS | 22 |
| 10 | TTYVSNTTY | 20 |
| 60 | YVEKSSTFF | 18 |
| 59 | NYVEKSSTF | 17 |
| 49 | EDFIQKSTS | 16 |
| 31 | FICSKEQEL | 14 |
| 33 | CSKEQELSY | 14 |
| 50 | DFIQKSTSC | 14 |
| 18 | YVSNATGSP | 12 |
| 62 | EKSSTFFKI | 12 |
| 23 | TGSPQPSIF | 11 |
| 52 | IQKSTSCNY | 11 |
| | V4-HLA-A26-9mers-282P1G3 Each peptide is a portion of SEQ ID NO: 9; each start position is specified, the length of peptide is 9 amino acids, and the end position for each peptide is the start position plus eight. | |
| 7 | EDLPEQPTF | 20 |
| 8 | DLPEQPTFL | 18 |

TABLE XXVI-continued

| pos | 123456789 | score |
|---|---|---|
| 1 | VTLYSGEDL | 17 |
| | V5-HLA-A26-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 13 |
| 5 | TVNSSNSIK | 13 |
| | V6-HLA-A26-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 29 |
| 1 | EEIEFIVPK | 20 |
| 4 | EFIVPKLEH | 15 |
| 5 | FIVPKLEHI | 14 |
| | V7-HLA-A26-9mers-282P1G3 Each peptide is a portion of SEQ ID NO: 15; each start position is specified, the length of peptide is 9 amino acids, and the end position for each peptide is the start position plus eight. | |
| 8 | EDNISHELF | 18 |
| 6 | IVEDNISHE | 17 |
| 10 | NISHELFTL | 17 |
| 14 | ELFTLHPEP | 15 |
| 2 | DFHVIVEDN | 14 |
| 4 | HVIVEDNIS | 14 |
| 9 | DNISHELFT | 14 |
| 5 | VIVEDNISH | 12 |
| 7 | VEDNISHEL | 10 |
| 1 | HDFHVIVED | 8 |
| 16 | FTLHPEPPR | 8 |

TABLE XXVII

| Pos | 123456789 | score |
|---|---|---|
| | V1-HLA-B0702-9mers-282P1G3 Each peptide is a portion of SEQ ID NO: 3; each start position is specified, the length of peptide is 9 amino acids, and the end position for each peptide is the start position plus eight. | |
| 988 | TPSKPSWHL | 26 |
| 810 | GPDPQSVTL | 24 |
| 151 | LPCNPPKGL | 23 |
| 154 | NPPKGLPPL | 23 |
| 539 | NPRIPKLHM | 23 |
| 542 | IPKLHMLEL | 23 |
| 991 | KPSWHLSNL | 23 |

TABLE XXVII-continued

| Pos | 123456789 | score |
|---|---|---|
| 2 | EPLLLGRGL | 22 |
| 133 | LPKEKIDPL | 21 |
| 828 | APVIHGVDV | 21 |
| 954 | LPKKLNGNL | 21 |
| 390 | HPFAGDVVF | 20 |
| 795 | APYDVKVQA | 20 |
| 1172 | QPTESADSL | 20 |
| 84 | IPSNNSGTF | 19 |
| 130 | VPKLPKEKI | 19 |
| 247 | KQRKPKLLL | 19 |
| 250 | KPKLLLPPT | 19 |
| 726 | APDRNPQNI | 19 |
| 730 | NPQNIRVQA | 19 |
| 62 | NPEPTFSWT | 18 |
| 127 | VPSVPKLPK | 18 |
| 352 | KPQSAVYST | 18 |
| 385 | SPVDNHPFA | 18 |
| 671 | EPGRWEELT | 18 |
| 758 | GPGLEYRVT | 18 |
| 772 | APVEWEEET | 18 |
| 1136 | HPDPEIQSV | 18 |
| 690 | LPLAPFVRY | 17 |
| 890 | RNSGMVPSL | 17 |
| 1019 | KPITEESST | 17 |
| 6 | LGRGLIVYL | 16 |
| 47 | FPFDEYFQI | 16 |
| 159 | LPPLHIYWM | 16 |
| 285 | TPQVDWNKI | 16 |
| 917 | GPESEPYIF | 16 |
| 1105 | AIALLTLLL | 16 |
| 218 | MPMKLTVNS | 15 |
| 268 | ILKGEILLL | 15 |
| 536 | SPKNPRIPK | 15 |
| 617 | ADITQVTVL | 15 |
| 627 | VPDPPENLH | 15 |
| 712 | QPSQPSDHH | 15 |
| 723 | PPAAPDRNP | 15 |
| 768 | KPQGAPVEW | 15 |
| 942 | KVDKDTATL | 15 |
| 11 | IVYLMFLLL | 14 |
| 27 | IPSSVQQVP | 14 |
| 208 | FPRLRTIVQ | 14 |
| 280 | AEGLPTPQV | 14 |
| 419 | ASNVHGTIL | 14 |
| 451 | TVVGYSAFL | 14 |
| 682 | QGKKTTVIL | 14 |
| 684 | KKTTVILPL | 14 |
| 931 | VPEQPTFLK | 14 |
| 1035 | IGKISGVNL | 14 |
| 1054 | EPGAEHIVR | 14 |
| 1158 | KPLKGSLRS | 14 |
| 1214 | GSSTATFPL | 14 |
| 39 | KQSKVQVAF | 13 |
| 59 | AKGNPEPTF | 13 |
| 71 | KDGNPFYFT | 13 |
| 125 | FIVPSVPKL | 13 |
| 143 | VEEGDPIVL | 13 |
| 155 | PPKGLPPLH | 13 |
| 203 | CCFAAFPRL | 13 |
| 205 | FAAFPRLRT | 13 |
| 297 | LPKGRETKE | 13 |
| 346 | PPRWTKKPQ | 13 |
| 370 | AEGEPQPTI | 13 |
| 432 | IDVVDVRPL | 13 |
| 517 | GKTAVTANL | 13 |
| 552 | CESKCDSHL | 13 |
| 558 | SHLKHSLKL | 13 |
| 584 | RIIIDGANL | 13 |
| 626 | DVPDPPENL | 13 |
| 628 | PDPPENLHL | 13 |
| 638 | ERQNRSVRL | 13 |
| 670 | EEPGRWEEL | 13 |
| 693 | APFVRYQFR | 13 |
| 787 | RVMTPAVYA | 13 |
| 812 | DPQSVTLYS | 13 |
| 824 | YPDTAPVIH | 13 |
| 921 | EPYIKFQTPE | 13 |

TABLE XXVII-continued

| Pos | 123456789 | score |
|---|---|---|
| 1001 | ATTKYKFYL | 13 |
| 1055 | PGAEHIVRL | 13 |
| 1094 | STQGWFIGL | 13 |
| 1103 | MCAIALLTL | 13 |
| 1106 | IALLTLLLL | 13 |
| | V2-(SET1)-HLA-B0702-9mers-282P1G3 Each peptide is a portion of SEQ ID NO: 5; each start position is specified, the length of peptide is 9 amino acids, and the end position for each peptide is the start postion plus eight. | |
| 9 | FPKEKIDPL | 21 |
| 6 | VPKFPKEKI | 19 |
| 3 | VPSVPKFPK | 16 |
| | V2-(SET2)-HLA-B0702-9mers-282P1G3 Each peptide is a portion of SEQ ID NO: 5; each start position is specified, the length of peptide is 9 amino acids, and the end postion for each peptide is the start position plus eight. | |
| 3 | LPKGREAKE | 13 |
| 9 | AKENYGKTL | 13 |
| 1 | GDLPKGREA | 8 |
| | V2-(SET3)-HLA-B0702-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 13 |
| 9 | KYAGLYDDI | 10 |
| 3 | STLGEGKYA | 9 |
| | V3-HLA-B0702-9mers-282P1G3 Each peptide is a portion of SEQ ID NO: 7; each start position is specified, the length of peptide is 9 amino acids, and the end position for each peptide is the start position plus eight. | |
| 22 | ATGSPQPSI | 13 |
| 27 | QPSIFICSK | 12 |
| 25 | SPQPSIFIC | 11 |
| 39 | LSYRNRNML | 11 |
| 24 | GSPQPSIFI | 10 |
| 31 | FICSKEQEL | 10 |
| 62 | EKSSTFFKI | 10 |
| 2 | IHGVDVINT | 9 |
| 23 | TGSPQPSIF | 9 |
| 38 | ELSYRNRNM | 9 |
| 44 | RNMLAEDFI | 9 |
| 48 | AEDFIQKST | 9 |
| 60 | YVEKSSTFF | 9 |
| 5 | VDVINTTYV | 8 |
| 8 | INTTYVSNT | 8 |
| 11 | TYVSNTTYV | 8 |

TABLE XXVII-continued

| Pos | 123456789 | score |
|---|---|---|
| 40 | SYRNRNMLA | 8 |
| 53 | QKSTSCNYV | 8 |
| 14 | SNTTYVSNA | 7 |
| 15 | NTTYVSNAT | 7 |
| 3 | HGVDVINTT | 6 |
| 9 | NTTYVSNTT | 6 |
| 43 | NRNMLAEDF | 6 |
| 58 | CNYVEKSST | 6 |
| 59 | NYVEKSSTF | 6 |
| | V4-HLA-B0702-9mers Each peptide is a portion of SEQ ID NO: 9; each start position is specified, the length of peptide is 9 amino acids, and the end position for each peptide is the start position plus eight. | |
| 9 | LPEQPTFLK | 14 |
| 8 | DLPEQPTFL | 12 |
| 1 | VTLYSGEDL | 11 |
| 6 | GEDLPEQPT | 11 |
| 7 | EDLPEQPTF | 9 |
| 3 | LYSGEDLPE | 7 |
| | V5-HLA-B0702-9mers Each peptide is a portion of SEQ ID NO: 11; each start position is specified, the length of peptide is 9 amino acids, and the end position for each peptide is the start position puls eight. | |
| 4 | LTVNSSNSI | 6 |
| 6 | VNSSNSIKQ | 2 |
| 7 | NSSNSIKQR | 2 |
| 9 | SNSIKQRKP | 2 |
| | V6-HLA-B0702-9mers Each peptide is a portion of SEQ ID NO: 13; each start position is specified, the length of peptide is 9 amino acids, and the end position for each peptide is the start position plus eight. | |
| 2 | EIEFIVPKL | 13 |
| 7 | VPKLEHIEQ | 10 |
| 5 | FIVPKLEHI | 7 |
| 4 | EFIVPKLEH | 6 |
| | V7-HLA-B0702-9mers Each peptide is a portion of SEQ ID NO: 15; each start position is specified, the length of peptide is 9 amino acids, and the end position for each peptide is the start position plus eight. | |
| 19 | HPEPPRWTK | 15 |
| 10 | NISHELFTL | 12 |
| 7 | VEDNISHEL | 11 |
| 9 | DNISHELFT | 9 |
| 18 | LHPEPPRWT | 9 |
| 8 | EDNISHELF | 7 |

TABLE XXVIII

| Pos | 123456789 | score |
|---|---|---|
| | V1-HLA-B08-9mers-282P1G3 Each peptide is a portion of SEQ ID NO: 3; each start position is specified, the length of peptide is 9 amino acids, and the end position for each peptide is the start position plus eight. | |
| 133 | LPKEKIDPL | 39 |
| 245 | SIKQRKPKL | 34 |
| 542 | IPKLHMLEL | 29 |
| 268 | ILKGEILLL | 28 |
| 954 | LPKKLNGNL | 27 |
| 849 | VPKDRVHGR | 26 |
| 1159 | PLKGSLRSL | 26 |
| 130 | VPKLPKEKI | 24 |
| 297 | LPKGRETKE | 24 |
| 855 | HGRLKGYQI | 24 |
| 1128 | SVKEKEDLH | 24 |
| 377 | TIKWRVNGS | 23 |
| 1203 | GSKEKGSVE | 23 |
| 208 | FPRLRTIVQ | 22 |
| 219 | PMKLTVNSL | 22 |
| 238 | EIGSKANSI | 22 |
| 246 | IKQRKPKLL | 22 |
| 266 | ITIKGEIL | 22 |
| 743 | EMIIKWEPL | 22 |
| 863 | INWWKTKSL | 22 |
| 1035 | IGKISGVNL | 22 |
| 1042 | NLTQKTHPI | 22 |
| 638 | ERQNRSVRL | 21 |
| 670 | EEPGRWEEL | 21 |
| 682 | QGKKTTVIL | 21 |
| 1002 | TTKYKFYLR | 21 |
| 104 | QGKYRCFAS | 20 |
| 248 | QRKPKLLLP | 20 |
| 481 | PLEGRRYHI | 20 |
| 530 | ATKLRVSPK | 20 |
| 540 | PRIPKLHML | 20 |
| 865 | WWKTKSLLD | 20 |
| 877 | HPKEVNILR | 20 |
| 1156 | DEKPLKGSL | 20 |
| 2 | EPLLLGRGL | 19 |
| 226 | SLKHANDSS | 19 |
| 537 | PKNPRIPKL | 19 |
| 563 | SLKLSWSKD | 19 |
| 740 | QPKEMIIKW | 19 |
| 796 | PYDVKVQAI | 19 |
| 937 | FLKVIKVDK | 19 |
| | V2-(SET1)-HLA-B08-9mers-(SET1)-282P1G3 Each peptide is a portion of SEQ ID NO: 5; each start position is specified, the length of peptide is 9 amino acids, and the end position for each peptide is the start position plus eight. | |
| 9 | FPKEKIDPL | 40 |
| 6 | VPKFPKEKI | 23 |
| | V2-(SET2)-HLA-B08-9mers-282P1G3 Each peptide is a portion of SEQ ID No: 5; each start position is specified, the length of peptide is 9 amino acids, and the end position for each peptide | |

TABLE XXVIII-continued

| Pos | 123456789 | score |
|---|---|---|
| | is the start position plus eight. | |
| 3 | LPKGREAKE | 24 |
| 8 | EAKENYGKT | 18 |
| 1 | GDLPKGREA | 12 |
| 6 | GREAKENYG | 11 |
| 9 | AKENYGKTL | 11 |
| | V2-(SET3)-HLA-B08-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 20 |
| 7 | EGKYAGLYD | 13 |
| 4 | TLGEGKYAG | 9 |
| | V3-HLA B08-9mers-282P1G3 Each peptide is a portion of SEQ ID NO: 7; each start position is specified, the length of peptide is 9 amino acids, and the end position for each peptide is the start position plus eight. | |
| 31 | FICSKEQEL | 26 |
| 38 | ELSYRNRNM | 18 |
| 59 | NYVEKSSTF | 18 |
| 40 | SYRNRNMLA | 17 |
| 33 | CSKEQELSY | 12 |
| | V4-HLA B08-9mers-282P1G3 Each peptide is a portion of SEQ ID NO: 9; each start position i s specified, the length of peptide is 9 amino acids, and the end position for each peptide is the start position plus eight. | |
| 8 | DLPEQPTFL | 18 |
| 1 | VTLYSGEDL | 12 |
| 7 | EDLPEQPTF | 8 |
| | V5-HLA-B08-9mers-282P1G3 Each peptide is a portion of SEQ ID NO: 11; each start position is specified, the length of peptide is 9 amino acids, and the end position for each peptide is the start position plus eight. | |
| 1 | PMKLTVNSS | 12 |
| 9 | SNSIKQRKP | 12 |
| 3 | KLTVNSSNS | 7 |
| 4 | LTVNSSNSI | 6 |
| | V6-HLA-B08-9mers-282P1G3 Each peptide is a portion of SEQ ID NO: 13; each start position is specified, the length of peptide is 9 amino acids, and the end | |

TABLE XXVIII-continued

| Pos | 123456789 | score |
|---|---|---|
| | position for each peptide is the start position plus eight. | |
| 5 | FIVPKLEHI | 21 |
| 7 | VPKLEHIEQ | 19 |
| 2 | EIEFIVPKL | 17 |
| | V7-HLA-B08-9mers-282P1G3 Each peptide is a portion of SEQ ID NO: 15; each start position is specified, the length of peptide is 9 amino acids, and the end position for each peptide is the start position plus eight. | |
| 10 | NISHELFTL | 14 |
| 7 | VEDNISHEL | 12 |
| 14 | ELFTLHPEP | 9 |
| 5 | VIVEDNISH | 8 |
| 8 | EDNISHELF | 8 |
| 20 | PEPPRWTKK | 8 |
| 3 | FHVIVEDNI | 7 |
| 19 | HPEPPRWTK | 7 |
| 17 | TLHPEPPRW | 6 |

TABLE XXIX

| Pos | 123456789 | score |
|---|---|---|
| | V1-HLA-B1510-9mers-282P1G3 Each peptide is a portion of SEQ ID NO: 3; each start position is specified, the length of peptide is 9 amino acies, and the end position for each peptide is the start position plus eight. | |
| 876 | THPKEVNIL | 23 |
| 487 | YHIYENGTL | 22 |
| 558 | SHLKHSLKL | 21 |
| 1055 | PGAEHIVRL | 17 |
| 432 | IDVVDVRPL | 16 |
| 810 | GPDPQSVTL | 16 |
| 101 | SHFQGKYRC | 15 |
| 143 | VEEGDPIVL | 15 |
| 638 | ERQNRSVRL | 15 |
| 6 | LGRGLIVYL | 14 |
| 125 | FIVPSVPKL | 14 |
| 172 | EHIEQDERV | 14 |
| 214 | IVQKMPMKL | 14 |
| 268 | ILKGEILLL | 14 |
| 336 | THDFHVIVE | 14 |
| 537 | PKNPRIPKL | 14 |
| 542 | IPKLHMLEL | 14 |
| 718 | DHHETPPAA | 14 |
| 719 | HHETPPAAP | 14 |
| 753 | SMEQNGPGL | 14 |
| 831 | IHGVDVINS | 14 |
| 890 | RNSGMVPSL | 14 |
| 988 | TPSKPSWHL | 14 |
| 1035 | IGKISGVNL | 14 |
| 2 | EPLLLGRGL | 13 |
| 154 | NPPKGLPPL | 13 |
| 203 | CCFAAFPRL | 13 |
| 245 | SIKQRKPKL | 13 |
| 246 | IKQRKPKLL | 13 |
| 247 | KQRKPKLLL | 13 |
| 261 | GSESSITIL | 13 |

TABLE XXIX-continued

| Pos | 123456789 | score |
|---|---|---|
| 267 | TILKGEILL | 13 |
| 303 | TKENYGKTL | 13 |
| 591 | NLTISNVTL | 13 |
| 617 | ADITQVTVL | 13 |
| 626 | DVPDPPENL | 13 |
| 653 | DHNSNISEY | 13 |
| 670 | EEPGRWEEL | 13 |
| 682 | QGKKTTVIL | 13 |
| 778 | EETVTNHTL | 13 |
| 833 | GVDVINSTL | 13 |
| 901 | FSEFHLTVL | 13 |
| 930 | GVPEQPTFL | 13 |
| 1047 | THPIEVFEP | 13 |
| 1058 | EHIVRLMTK | 13 |
| 1100 | IGLMCAIAL | 13 |
| 1127 | YSVKEKEDL | 13 |
| 1156 | DEKPLKGSL | 13 |
| 1159 | PLKGSLRSL | 13 |
| 1182 | EYGEGDHGL | 13 |
| 9 | GLIVYLMFL | 12 |
| 11 | IVYLMFLLL | 12 |
| 133 | LPKEKIDPL | 12 |
| 151 | LPCNPPKGL | 12 |
| 174 | IEQDERVYM | 12 |
| 266 | ITILKGEIL | 12 |
| 358 | YSTGSNGIL | 12 |
| 389 | NHPFAGDVV | 12 |
| 451 | TVVGYSAFL | 12 |
| 474 | QKVEEVKPL | 12 |
| 540 | PRIPKLHML | 12 |
| 550 | LHCESKCDS | 12 |
| 552 | CESKCDSHL | 12 |
| 556 | CDSHLKHSL | 12 |
| 605 | YCCSAHTAL | 12 |
| 628 | PDPPENLHL | 12 |
| 657 | NISEYIVEF | 12 |
| 783 | NHTLRVMTP | 12 |
| 799 | VKVQAINQL | 12 |
| 850 | PKDRVHGRL | 12 |
| 863 | INWWKTKSL | 12 |
| 864 | NWWKTKSLL | 12 |
| 878 | PKEVNILRF | 12 |
| 942 | KVDKDTATL | 12 |
| 950 | LSWGLPKKL | 12 |
| 973 | NDTYEIGEL | 12 |
| 994 | WHLSNLNAT | 12 |
| 1001 | ATTKYKFYL | 12 |
| 1020 | PITEESSTL | 12 |
| 1101 | GLMCAIALL | 12 |
| 1103 | MCAIALLTL | 12 |
| 1106 | IALLTLLLL | 12 |
| 1135 | LHPDPEIQS | 12 |
| 1214 | GSSTATFPL | 12 |
| 10 | LIVYLMFLL | 11 |
| 39 | KQSKVQVAF | 11 |
| 80 | DHRIIPSNN | 11 |
| 84 | IPSNNSGTF | 11 |
| 98 | GHISHFQGK | 11 |
| 107 | YRCFASNKL | 11 |
| 162 | LHIYWMNIE | 11 |
| 163 | HIYWMNIEL | 11 |
| 180 | VYMSQKGDL | 11 |
| 219 | PMKLTVNSL | 11 |
| 228 | KHANDSSSS | 11 |
| 275 | LLECFAEGL | 11 |
| 289 | DWNKIGGDL | 11 |
| 324 | YRCTASNFL | 11 |
| 359 | STGSNGILL | 11 |
| 390 | HPFAGDVVF | 11 |
| 399 | PREISFTNL | 11 |
| 419 | ASNVHGTIL | 11 |
| 459 | LHCEFFASP | 11 |
| 517 | GKTAVTANL | 11 |
| 525 | LDIRNATKL | 11 |
| 561 | KHSLKLSWS | 11 |
| 609 | AHTALDSAA | 11 |
| 634 | LHLSERQNR | 11 |

TABLE XXIX-continued

| Pos | 123456789 | score |
|---|---|---|
| 684 | KKTTVILPL | 11 |
| 743 | EMIIKWEPL | 11 |
| 854 | VHGRLKGRQ | 11 |
| 898 | LDAFSEFHL | 11 |
| 929 | EGVPEQPTF | 11 |
| 946 | DTATLSWGL | 11 |
| 954 | LPKKLNGNL | 11 |
| 991 | KPSWHLSNL | 11 |
| 1056 | GAEHIVRLM | 11 |
| 1081 | TRGREYAGL | 11 |
| 1094 | STQGWFIGL | 11 |
| 1105 | AIALLTLLL | 11 |
| 1141 | IQSVKDETF | 11 |
| 1152 | YSDSDEKPL | 11 |
| | V2-(SET1)-HLA-B1510-9mers-(SET1)-282P1G3 Each peptide is a portion of SEQ ID NO: 5; each start position is specified, the length of peptide is 9 amino acids, and the end position for each peptide is the start position plus eight. | |
| 9 | FPKEKIDPL | 12 |
| 1 | FIVPSVPKF | 10 |
| | V2-(SET2)-HLA-B1510-9mers-282P1G3 Each peptide is a portion of SEQ ID NO: 5; each start position is specified, the length of peptide is 9 amino acids, and the end position for each peptide is the start position plus eight. | |
| 9 | AKENYGKTL | 12 |
| 1 | GDLPKGREA | 6 |
| | V2-(SET3)-HLA-B1510-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 12 |
| 4 | TLGEGKYAG | 5 |
| | V3-HLA-B1510-9mers-282P1G3 Each peptide is a portion of SEQ ID NO: 7; each start position is specified, the length of peptide is 9 amino acids, and the end position for each peptide is the start position plus eight. | |
| 2 | IHGVDVINT | 14 |
| 39 | LSYRNRNML | 12 |
| 23 | TGSPQPSIF | 11 |
| 31 | FICSKEQEL | 11 |
| 38 | ELSYRNRNM | 10 |
| 60 | YVEKSSTFF | 9 |
| 59 | NYVEKSSTF | 8 |
| 43 | NRNMLAEDF | 6 |
| | V4-HLA-B1510-9mers-282P1G3 Each peptide is a portion of SEQ ID NO: 9; each start position is specified, the length of peptide is 9 amino acids, and the end position for each peptide is the start position plus eight. | |
| 8 | DLPEQPTFL | 12 |
| 7 | EDLPEQPTF | 11 |
| 1 | VTLYSGEDL | 10 |
| | V5-HLA-B1510-9mers-282P1G3 Each peptide is a portion of SEQ ID NO: 11; each start position is specified, the length of peptide is 9 amino acids, and the end position for each peptide is the start position plus eight. | |
| 8 | SSNSIKQRK | 3 |
| 9 | SNSIKQRKP | 3 |
| 3 | KLTVNSSNS | 2 |
| 6 | VNSSNSIKQ | 2 |
| 7 | NSSNSIKQR | 2 |
| 1 | PMKLTVNSS | 1 |
| 5 | TVNSSNSIK | 1 |
| | V6-HLA-B1510-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 14 |
| | V7-HLA-B1510-9mers-282P1G3 Each peptide is a portion of SEQ ID NO: 15; each start position is specified, the length of peptide is 9 amino acids, and the end position for each peptide is the start position plus eight. | |
| 18 | LHPEPPRWT | 15 |
| 10 | NISHELFTL | 12 |
| 7 | VEDNISHEL | 11 |
| 12 | SHELFTLHP | 11 |
| 3 | FHVIVEDNI | 10 |
| 8 | EDNISHELF | 7 |
| 17 | TLHPEPPRW | 7 |

TABLE XXX

| Pos | 123456789 | score |
|---|---|---|
| | V1-HLA-B2705-9mers-282P1G3 Each peptide is a portion of SEQ ID NO: 3; each start position is specified, the length of peptide is 9 | |

TABLE XXX-continued

| Pos | 123456789 | score |
|---|---|---|
| | amino acids, and the end position for each peptide is the start position plus eight. | |
| 209 | PRLRTIVQK | 27 |
| 7 | GRGLIVYLM | 25 |
| 399 | PREISFTNL | 25 |
| 540 | PRIPKLHML | 25 |
| 734 | IRVQASQPK | 25 |
| 1122 | NRGGKYSVK | 25 |
| 107 | YRCFASNKL | 24 |
| 533 | LRVSPKNPR | 24 |
| 638 | ERQNRSVRL | 24 |
| 324 | YRCTASNFL | 22 |
| 1081 | TRGREYAGL | 22 |
| 786 | LRVMTPAVY | 21 |
| 673 | GRWEELTRV | 20 |
| 92 | FRIPNEGHI | 19 |
| 261 | GSESSITIL | 19 |
| 301 | RETKENYGK | 19 |
| 485 | RRYHIYENG | 19 |
| 584 | RIIIDGANL | 19 |
| 856 | GRLKGYQIN | 19 |
| 859 | KGYQINWWK | 19 |
| 884 | LRFSGQRNS | 19 |
| 890 | RNSGMVPSL | 19 |
| 1189 | GLFSEDGSF | 19 |
| 1199 | GAYAGSKEK | 19 |
| 8 | RGLIVYLMF | 18 |
| 39 | KQSKVQVAF | 18 |
| 268 | ILKGEILLL | 18 |
| 271 | GEILLLECF | 18 |
| 291 | NKIGGDLPK | 18 |
| 390 | HPFAGDVVF | 18 |
| 437 | VRPLIQTKD | 18 |
| 484 | GRRYHIYEN | 18 |
| 558 | SHLKHSLKL | 18 |
| 562 | HSLKLSWSK | 18 |
| 799 | VKVQAINQL | 18 |
| 6 | LGRGLIVYL | 17 |
| 9 | GLIVYLMFL | 17 |
| 81 | HRIIPSNNS | 17 |
| 125 | FIVPSVPKL | 17 |
| 247 | KQRKPKLLL | 17 |
| 267 | TILKGEILL | 17 |
| 284 | PTPQVDWNK | 17 |
| 304 | KENYGKTLK | 17 |
| 517 | GKTAVTANL | 17 |
| 525 | LDIRNATKL | 17 |
| 537 | PKNPRIPKL | 17 |
| 583 | GRIIIDGAN | 17 |
| 617 | ADITQVTVL | 17 |
| 679 | TRVQGKKTT | 17 |
| 684 | KKTTVILPL | 17 |
| 709 | GRSQPSQPS | 17 |
| 810 | GPDPQSVTL | 17 |
| 833 | GVDVINSTL | 17 |
| 893 | GMVPSLDAF | 17 |
| 929 | EGVPEQPTF | 17 |
| 1055 | PGAEHIVRL | 17 |
| 1101 | GLMCAIALL | 17 |
| 1150 | GEYSDSDEK | 17 |
| 1161 | KGSLRSLNR | 17 |
| 15 | MFLLLKFSK | 16 |
| 95 | PNEGHISHF | 16 |
| 106 | KYRCFASNK | 16 |
| 149 | IVLPCNPPK | 16 |
| 154 | NPPKGLPPL | 16 |
| 182 | MSQKGDLYF | 16 |
| 191 | ANVEEKDSR | 16 |
| 203 | CCFAAFPRL | 16 |
| 210 | RLRTIVQKM | 16 |
| 212 | RTIVQKMPM | 16 |
| 214 | IVQKMPMKL | 16 |
| 242 | KANSIKQRK | 16 |
| 245 | SIKQRKPKL | 16 |
| 329 | SNFLGTATH | 16 |

TABLE XXX-continued

| Pos | 123456789 | score |
|---|---|---|
| 380 | WRVNGSPVD | 16 |
| 396 | VVFPREISF | 16 |
| 424 | GTILANANI | 16 |
| 430 | ANIDVVDVR | 16 |
| 436 | DVRPLIQTK | 16 |
| 491 | ENGTLQINR | 16 |
| 534 | RVSPKNPRI | 16 |
| 657 | NISEYIVEF | 16 |
| 687 | TVILPLAPF | 16 |
| 760 | GLEYRVTWK | 16 |
| 852 | DRVHGRLKG | 16 |
| 874 | GRTHPKEVN | 16 |
| 878 | PKEVNILRF | 16 |
| 930 | GVPEQPTFL | 16 |
| 942 | KVDKDTATL | 16 |
| 949 | TLSWGLPKK | 16 |
| 954 | LPKKLNGNL | 16 |
| 991 | KPSWHLSNL | 16 |
| 1074 | IFQDVIETR | 16 |
| 1104 | CAIALLTLL | 16 |
| 1106 | IALLTLLLL | 16 |
| 1124 | GGKYSVKEK | 16 |
| 1137 | PDPEIQSVK | 16 |
| 11 | IVYLMFLLL | 15 |
| 13 | YLMFLLLKF | 15 |
| 41 | SKVQVAFPF | 15 |
| 45 | VAFPFDEYF | 15 |
| 98 | GHISHFQGK | 15 |
| 124 | EFIVPSVPK | 15 |
| 133 | LPKEKIDPL | 15 |
| 157 | KGLPPLHIY | 15 |
| 163 | HIYWMNIEL | 15 |
| 188 | LYFANVEEK | 15 |
| 213 | TIVQKMPMK | 15 |
| 220 | MKLTVNSLK | 15 |
| 234 | SSSTEIGSK | 15 |
| 239 | IGSKANSIK | 15 |
| 241 | SKANSIKQR | 15 |
| 266 | ITILKGEIL | 15 |
| 296 | DLPKGRETK | 15 |
| 300 | GRETKENYG | 15 |
| 316 | VSYQDKGNY | 15 |
| 344 | EEPPRWTKK | 15 |
| 450 | ATVVGYSAF | 15 |
| 451 | TVVGYSAFL | 15 |
| 477 | EEVKPLEGR | 15 |
| 480 | KPLEGRRYH | 15 |
| 487 | YHIYENGTL | 15 |
| 527 | IRNATKLRV | 15 |
| 634 | LHLSERQNR | 15 |
| 677 | ELTRVQGKK | 15 |
| 696 | VRYQFRVIA | 15 |
| 728 | DRNPQNIRV | 15 |
| 744 | MIIKWEPLK | 15 |
| 792 | AVYAPYDVK | 15 |
| 835 | DVINSTLVK | 15 |
| 853 | RVHGRLKGY | 15 |
| 875 | RTHPKEVNI | 15 |
| 876 | THPKEVNIL | 15 |
| 917 | GPESEPYIF | 15 |
| 950 | LSWGLPKKL | 15 |
| 957 | KLNGNLTGY | 15 |
| 973 | NDTYEIGEL | 15 |
| 988 | TPSKPSWHL | 15 |
| 996 | LSNLNATTK | 15 |
| 1020 | PITEESSTL | 15 |
| 1029 | GEGSKGIGK | 15 |
| 1030 | EGSKGIGKI | 15 |
| 1035 | IGKISGVNL | 15 |
| 1038 | ISGVNLTQK | 15 |
| 1040 | GVNLTQKTH | 15 |
| 1045 | QKTHPIEVF | 15 |
| 1051 | EVFEPGAEH | 15 |
| 1058 | EHIVRLMTK | 15 |
| 1100 | IGLMCAIAL | 15 |
| 1110 | TLLLLTVCF | 15 |
| 1127 | YSVKEKEDL | 15 |

TABLE XXX-continued

| Pos | 123456789 | score |
|---|---|---|
| 1159 | PLKGSLRSL | 15 |
| 2 | EPLLLGRGL | 14 |
| 12 | VYLMFLLLK | 14 |
| 59 | AKGNPEPTF | 14 |
| 94 | IPNEGHISH | 14 |
| 117 | IAMSEEIEF | 14 |
| 129 | SVPKLPKEK | 14 |
| 143 | VEEGDPIVL | 14 |
| 171 | LEHIEQDER | 14 |
| 178 | ERVYMSQKG | 14 |
| 219 | PMKLTVNSL | 14 |
| 221 | KLTVNSLKH | 14 |
| 244 | NSIKQRKPK | 14 |
| 248 | QRKPKLLLP | 14 |
| 299 | KGRETKENY | 14 |
| 305 | ENYGKTLKI | 14 |
| 323 | NYRCTASNF | 14 |
| 340 | HVIVEEPPR | 14 |
| 343 | VEEPPRWTK | 14 |
| 347 | PRWTKKPQS | 14 |
| 358 | YSTGSNGIL | 14 |
| 373 | EPQPTIKWR | 14 |
| 384 | GSPVDNHPF | 14 |
| 403 | SFTNLQPNH | 14 |
| 456 | SAFLHCEFF | 14 |
| 467 | PEAVVSWQK | 14 |
| 472 | SWQKVEEVK | 14 |
| 474 | QKVEEVKPL | 14 |
| 478 | EVKPLEGRR | 14 |
| 510 | CWVENAIGK | 14 |
| 530 | ATKLRVSPK | 14 |
| 542 | IPKLHMLEL | 14 |
| 552 | CESKCDSHL | 14 |
| 591 | NLTISNVTL | 14 |
| 628 | PDPPENLHL | 14 |
| 631 | PENLHLSER | 14 |
| 637 | SERQNRSVR | 14 |
| 661 | YIVEFEGNK | 14 |
| 666 | EGNKEEPGR | 14 |
| 690 | LPLAPFVRY | 14 |
| 693 | APFVRYQFR | 14 |
| 700 | FRVIAVNEV | 14 |
| 727 | PDRNPQNIR | 14 |
| 739 | SQPKEMIIK | 14 |
| 756 | QNGPGLEYR | 14 |
| 763 | YRVTWKPQG | 14 |
| 776 | WEEETVTNH | 14 |
| 811 | PDPQSVTLY | 14 |
| 843 | KVTWSTVPK | 14 |
| 864 | NWWKTKSLL | 14 |
| 867 | KTKSLLDGR | 14 |
| 869 | KSLLDGRTH | 14 |
| 877 | HPKEVNILR | 14 |
| 882 | NILRFSGQR | 14 |
| 896 | PSLDAFSEF | 14 |
| 901 | FSEFHLTVL | 14 |
| 906 | LTVLAYNSK | 14 |
| 915 | GAGPESEPY | 14 |
| 948 | ATLSWGLPK | 14 |
| 963 | TGYLLQYQI | 14 |
| 997 | SNLNATTKY | 14 |
| 999 | LNATTKYKF | 14 |
| 1001 | ATTKYKFYL | 14 |
| 1025 | SSTLGEGSK | 14 |
| 1061 | VRLMTKNWG | 14 |
| 1082 | RGREYAGLY | 14 |
| 1083 | GREYAGLYD | 14 |
| 1091 | DDISTQGWF | 14 |
| 1105 | AIALLTLLL | 14 |
| 1112 | LLLTVCFVK | 14 |
| 1115 | TVCFVKRNR | 14 |
| 1120 | KRNRGGKYS | 14 |
| 1141 | IQSVKDETF | 14 |
| 1156 | DEKPLKGSL | 14 |
| 1172 | QPTESADSL | 14 |
| 1182 | EYGEGDHGL | 14 |
| 5 | LLGRGLIVY | 13 |

TABLE XXX-continued

| Pos | 123456789 | score |
|---|---|---|
| 19 | LKFSKAIEI | 13 |
| 34 | VPTIIKQSK | 13 |
| 63 | PEPTFSWTK | 13 |
| 68 | SWTKDGNPF | 13 |
| 73 | GNPFYFTDH | 13 |
| 74 | NPFYFTDHR | 13 |
| 84 | IPSNNSGTF | 13 |
| 85 | PSNNSGTFR | 13 |
| 102 | HFQGKYRCF | 13 |
| 111 | ASNKLGIAM | 13 |
| 127 | VPSVPKLPK | 13 |
| 159 | LPPLHIYWM | 13 |
| 200 | NDYCCFAAF | 13 |
| 206 | AAFPRLRTI | 13 |
| 211 | LRTIVQKMP | 13 |
| 289 | DWNKIGGDL | 13 |
| 370 | AEGEPQPTI | 13 |
| 371 | EGEPQPTIK | 13 |
| 419 | ASNVHGTIL | 13 |
| 432 | IDVVDVRPL | 13 |
| 441 | IQTKDGENY | 13 |
| 524 | NLDIRNATK | 13 |
| 556 | CDSHLKHSL | 13 |
| 557 | DSHLKHSLK | 13 |
| 597 | VTLEDQGIY | 13 |
| 626 | DVPDPPENL | 13 |
| 641 | NRSVRLTWE | 13 |
| 644 | VRLTWEAGA | 13 |
| 653 | DHNSNISEY | 13 |
| 670 | EEPGRWEEL | 13 |
| 672 | PGRWEELTR | 13 |
| 676 | EELTRVQGK | 13 |
| 682 | QGKKTTVIL | 13 |
| 689 | ILPLAPFVR | 13 |
| 692 | LAPFVRYQF | 13 |
| 721 | ETPPAAPDR | 13 |
| 743 | EMIIKWEPL | 13 |
| 746 | IKWEPLKSM | 13 |
| 753 | SMEQNGPGL | 13 |
| 755 | EQNGPGLEY | 13 |
| 779 | ETVTNHTLR | 13 |
| 847 | STVPKDRVH | 13 |
| 850 | PKDRVHGRL | 13 |
| 861 | YQINWWKTK | 13 |
| 863 | INWWKTKSL | 13 |
| 889 | QRNSGMVPS | 13 |
| 931 | VPEQPTFLK | 13 |
| 934 | QPTFLKVIK | 13 |
| 937 | FLKVIKVDK | 13 |
| 946 | DTATLSWGL | 13 |
| 961 | NLTGYLLQY | 13 |
| 976 | YEIGELNDI | 13 |
| 1054 | EPGAEHIVR | 13 |
| 1056 | GAEHIVRLM | 13 |
| 1094 | STQGWFIGL | 13 |
| 1103 | MCAIALLTL | 13 |
| 1113 | LLTVCFVKR | 13 |
| 1153 | SDSDEKPLK | 13 |
| 1157 | EKPLKGSLR | 13 |
| 1168 | NRDMQPTES | 13 |
| 1212 | SNGSSTATF | 13 |
| 1214 | GSSTATFPL | 13 |
| | V2-(SET1)-HLA-B2705-9mers-282P1G3 Each peptide is a portion of SEQ ID NO: 5; each start position is specified, the length of peptide is 9 amino acids, and the end position for each peptide is the start position plus eight. | |
| 1 | FIVPSVPKF | 17 |
| 9 | FPKEKIDPL | 15 |
| 5 | SVPKFPKEK | 13 |

TABLE XXX-continued

| Pos | 123456789 | score |
|---|---|---|
| 3 | VPSVPKFPK | 12 |
| 6 | VPKFPKEKI | 10 |
| | V2-(SET2)-HLA-B2705-9mers-(SET1)-282P1G3 Each peptide is a portion of SEQ ID NO: 5; each start position is specified, the length of peptide is 9 amino acids, and the end position for each peptide is the start position plus eight. | |
| 7 | REAKENYGK | 19 |
| 6 | GREAKENYG | 15 |
| 2 | DLPKGREAK | 14 |
| 5 | KGREAKENY | 14 |
| 9 | AKENYGKTL | 12 |
| | V2-(SET3)-HLA-B2705-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 14 |
| 6 | GEGKYAGLY | 14 |
| 2 | SSTLGEGKY | 13 |
| 1 | ESSTLGEGK | 11 |
| 9 | KYAGLYDDI | 11 |
| 8 | GKYAGLYDD | 9 |
| | V3-HLA-B2705-9mers-282P1G3 Each peptide is a portion of SEQ ID NO: 7; each start position is specified, the length of peptide is 9 amino acids, and the end position for each peptide is the start position plus eight. | |
| 43 | NRNMLAEDF | 22 |
| 4 | GVDVINTTY | 16 |
| 59 | NYVEKSSTF | 16 |
| 60 | YVEKSSTFF | 16 |
| 10 | TTYVSNTTY | 15 |
| 34 | SKEQELSYR | 15 |
| 24 | GSPQPSIFI | 14 |
| 27 | QPSIFICSK | 14 |
| 36 | EQELSYRNR | 14 |
| 39 | LSYRNRNML | 13 |
| 46 | MLAEDFIQK | 13 |
| 22 | ATGSPQPSI | 12 |
| 23 | TGSPQPSIF | 12 |
| 31 | FICSKEQEL | 12 |
| 52 | IQKSTSCNY | 12 |
| 55 | STSCNYVEK | 12 |
| 33 | CSKEQELSY | 11 |
| 38 | ELSYRNRNM | 11 |
| 41 | YRNRNMLAE | 11 |
| 44 | RNMLAEDFI | 11 |
| 61 | VEKSSTFFK | 11 |
| | V4-HLA-B2705-9mers-282P1G3 Each peptide is a portion of SEQ ID NO: 9; each start position is specified, the length of peptide is 9 amino acids, and the end position for each peptide is the start position plus eight. | |
| 7 | EDLPEQPTF | 18 |
| 1 | VTLYSGEDL | 13 |
| 8 | DLPEQPTFL | 13 |
| 9 | LPEQPTFLK | 13 |
| | V5-HLA-B2705-9mers-282P1G3 Each peptide is a portion of SEQ ID NO: 11; each start position is specified, the length of peptide is 9 amino acids, and the end position for each peptide is the start position plus eight. | |
| 7 | NSSNSIKQR | 15 |
| 8 | SSNSIKQRK | 14 |
| 5 | TVNSSNSIK | 13 |
| 4 | LTVNSSNSI | 11 |
| | V6-HLA-B2705-9mers-282P1G3 Each peptide is a portion of SEQ ID NO: 13; each start position is specified, the length of peptide is 9 amino acids, and the end position for each peptide is the start position plus eight. | |
| 1 | EEIEFIVPK | 17 |
| 2 | EIEFIVPKL | 15 |
| 4 | EFIVPKLEH | 14 |
| 5 | FIVPKLEHI | 10 |
| | V7-HLA-B2705-9mers-282P1G3 Each peptide is a portion of SEQ ID NO: 15; each start position is specified, the length of peptide is 9 amino acids, and the end position for each peptide is the start position plus eight. | |
| 20 | PEPPRWTKK | 15 |
| 16 | FTLHPEPPR | 14 |
| 19 | HPEPPRWTK | 14 |
| 5 | VIVEDNISH | 13 |
| 7 | VEDNISHEL | 13 |
| 10 | NISHELFTL | 13 |
| 11 | ISHELFTLH | 13 |
| 8 | EDNISHELF | 11 |
| 3 | FHVIVEDNI | 10 |
| 1 | HDFHVIVED | 9 |

TABLE XXXI

| Pos | 123456789 | score |
|---|---|---|
| | V1-HLA-2709-9mers-282P1G3 Each peptide is a portion of SEQ ID NO: 3; each start position is specified, the length of peptide is 9 amino acids, and the end position for each peptide is the start position plus eight. | |
| 7 | GRGLIVYLM | 24 |
| 540 | PRIPKLHML | 22 |

TABLE XXXI-continued

| Pos | 123456789 | score |
|---|---|---|
| 638 | ERQNRSVRL | 22 |
| 673 | GRWEELTRV | 22 |
| 399 | PREISFTNL | 21 |
| 527 | IRNATKLRV | 21 |
| 92 | FRIPNEGHI | 20 |
| 107 | YRCFASNKL | 20 |
| 324 | YRCTASNFL | 20 |
| 700 | FRVIAVNEV | 20 |
| 728 | DRNPQNIRV | 20 |
| 1081 | TRGREYAGL | 20 |
| 485 | RRYHIYENG | 18 |
| 584 | RIIIDGANL | 17 |
| 890 | RNSGMVPSL | 16 |
| 8 | RGLIVYLMF | 15 |
| 517 | GKTAVTANL | 15 |
| 534 | RVSPKNPRI | 15 |
| 583 | GRIIIDGAN | 15 |
| 810 | GPDPQSVTL | 15 |
| 856 | GRLKGYQIN | 15 |
| 875 | RTHPKEVNI | 15 |
| 9 | GLIVYLMFL | 14 |
| 11 | IVYLMFLLL | 14 |
| 125 | FIVPSVPKL | 14 |
| 203 | CCFAAFPRL | 14 |
| 209 | PRLRTIVQK | 14 |
| 210 | RLRTIVQKM | 14 |
| 261 | GSESSITIL | 14 |
| 432 | IDVVDVRPL | 14 |
| 484 | GRRYHIYEN | 14 |
| 684 | KKTTVILPL | 14 |
| 833 | GVDVINSTL | 14 |
| 874 | GRTHPKEVN | 14 |
| 884 | LRFSGQRNS | 14 |
| 1083 | GREYAGLYD | 14 |
| 1100 | IGLMCAIAL | 14 |
| 1106 | IALLTLLLL | 14 |
| 1189 | GLFSEDGSF | 14 |
| 212 | RTIVQKMPM | 13 |
| 247 | KQRKPKLLL | 13 |
| 300 | GRETKENYG | 13 |
| 308 | GKTLKIENV | 13 |
| 424 | GTILANANI | 13 |
| 558 | SHLKHSLKL | 13 |
| 617 | ADITQVTVL | 13 |
| 688 | VILPLAPFV | 13 |
| 696 | VRYQFRVIA | 13 |
| 697 | RYQFRVIAV | 13 |
| 709 | GRSQPSQPS | 13 |
| 763 | YRVTWKPQG | 13 |
| 808 | GSGPDPQSV | 13 |
| 893 | GMVPSLDAF | 13 |
| 917 | GPESEPYIF | 13 |
| 930 | GVPEQPTFL | 13 |
| 942 | KVDKDTATL | 13 |
| 964 | GYLLQYQII | 13 |
| 991 | KPSWHLSNL | 13 |
| 1035 | IGKISGVNL | 13 |
| 1056 | GAEHIVRLM | 13 |
| 1101 | GLMCAIALL | 13 |
| 1121 | RNRGGKYSV | 13 |
| 1214 | GSSTATFPL | 13 |
| 2 | EPLLLGRGL | 12 |
| 19 | LKFSKAIEI | 12 |
| 23 | KAIEIPSSV | 12 |
| 81 | HRIIPSNNS | 12 |
| 135 | KEKIDPLEV | 12 |
| 163 | HIYWMNIEL | 12 |
| 206 | AAFPRLRTI | 12 |
| 248 | QRKPKLLLP | 12 |
| 266 | ITILKGEIL | 12 |
| 267 | TILKGEILL | 12 |
| 268 | ILKGEILLL | 12 |
| 271 | GEILLLECF | 12 |
| 347 | PRWTKKPQS | 12 |
| 380 | WRVNGSPVD | 12 |
| 384 | GSPVDNHPF | 12 |
| 394 | GDVVFPREI | 12 |

TABLE XXXI-continued

| Pos | 123456789 | score |
|---|---|---|
| 474 | QKVEEVKPL | 12 |
| 525 | LDIRNATKL | 12 |
| 533 | LRVSPKNPR | 12 |
| 537 | PKNPRIPKL | 12 |
| 542 | IPKLHMLEL | 12 |
| 589 | GANLTISNV | 12 |
| 591 | NLTISNVTL | 12 |
| 628 | PDPPENLHL | 12 |
| 644 | VRLTWEAGA | 12 |
| 680 | RVQGKKTTV | 12 |
| 734 | IRVQASQPK | 12 |
| 799 | VKVQAINQL | 12 |
| 822 | EDYPDTAPV | 12 |
| 852 | DRVHGRLKG | 12 |
| 889 | QRNSGMVPS | 12 |
| 963 | TGYLLQYQI | 12 |
| 1001 | ATTKYKFYL | 12 |
| 1055 | PGAEHIVRL | 12 |
| 1061 | VRLMTKNWG | 12 |
| 1105 | AIALLTLLL | 12 |
| 1120 | KRNRGGKYS | 12 |
| 1152 | YSDSDEKPL | 12 |
| 1172 | QPTESADSL | 12 |
| 4 | LLLGRGLIV | 11 |
| 6 | LGRGLIVYL | 11 |
| 10 | LIVYLMFLL | 11 |
| 26 | EIPSSVQQV | 11 |
| 29 | SSVQQVPTI | 11 |
| 37 | IIKQSKVQV | 11 |
| 39 | KQSKVQVAF | 11 |
| 45 | VAFPFDEYF | 11 |
| 47 | FPFDEYFQI | 11 |
| 75 | PFYFTDHRI | 11 |
| 76 | FYFTDHRII | 11 |
| 122 | EIEFIVPSV | 11 |
| 143 | VEEGDPIVL | 11 |
| 154 | NPPKGLPPL | 11 |
| 178 | ERVYMSQKG | 11 |
| 180 | VYMSQKGDL | 11 |
| 185 | KGDLYFANV | 11 |
| 211 | LRTIVQKMP | 11 |
| 214 | IVQKMPMKL | 11 |
| 219 | PMKLTVNSL | 11 |
| 245 | SIKQRKPKL | 11 |
| 246 | IKQRKPKLL | 11 |
| 275 | LLECFAEGL | 11 |
| 280 | AEGLPTPQV | 11 |
| 289 | DWNKIGGDL | 11 |
| 305 | ENYGKTLKI | 11 |
| 333 | GTATHDFHV | 11 |
| 358 | YSTGSNGIL | 11 |
| 359 | STGSNGILL | 11 |
| 390 | HPFAGDVVF | 11 |
| 396 | VVFPREISF | 11 |
| 419 | ASNVHGTIL | 11 |
| 429 | NANIDVVDV | 11 |
| 437 | VRPLIQTKD | 11 |
| 451 | TVVGYSAFL | 11 |
| 487 | YHIYENGTL | 11 |
| 489 | IYENGTLQI | 11 |
| 498 | NRTTEEDAG | 11 |
| 579 | GTEDGRIII | 11 |
| 605 | YCCSAHTAL | 11 |
| 611 | TALDSAADI | 11 |
| 619 | ITQVTVLDV | 11 |
| 626 | DVPDPPENL | 11 |
| 679 | TRVQGKKTT | 11 |
| 682 | QGKKTTVIL | 11 |
| 743 | EMIIKWEPL | 11 |
| 753 | SMEQNGPGL | 11 |
| 778 | EETVTNHTL | 11 |
| 780 | TVTNHTLRV | 11 |
| 786 | LRVMTPAVY | 11 |
| 828 | APVIHGVDV | 11 |
| 850 | PKDRVHGRL | 11 |
| 863 | INWWKTKSL | 11 |
| 876 | THPKEVNIL | 11 |

TABLE XXXI-continued

| Pos | 123456789 | score |
|---|---|---|
| 929 | EGVPEQPTF | 11 |
| 935 | PTFLKVIKV | 11 |
| 954 | LPKKLNGNL | 11 |
| 959 | NGNLTGYLL | 11 |
| 970 | QIINDTYEI | 11 |
| 973 | NDTYEIGEL | 11 |
| 1020 | PITEESSTL | 11 |
| 1033 | KGIGKISGV | 11 |
| 1066 | KNWGDNDSI | 11 |
| 1103 | MCAIALLTL | 11 |
| 1104 | CAIALLTLL | 11 |
| 1110 | TLLLLTVCF | 11 |
| 1111 | LLLLTVCFV | 11 |
| 1127 | YSVKEKEDL | 11 |
| 1133 | EDLHPDPEI | 11 |
| 1156 | DEKPLKGSL | 11 |
| | V2-(SET1)-HLA-B2709-9mers-282P1G3 Each peptide is a portion of SEQ ID NO: 5; each start position is specified, the length of peptide is 9 amino acids, and the end position for each peptide is the start position plus eight. | |
| 1 | FIVPSVPKF | 12 |
| 9 | FPKEKIDPL | 10 |
| 6 | VPKFPKEKI | 8 |
| | V2-(SET2)-HLA-B2709-9mers-282P1G3 Each peptide is a portion of SEQ ID NO: 5; each start position is specified, the length of peptide is 9 amino acids, and the end position for each peptide is the start position plus eight. | |
| 6 | GREAKENYG | 13 |
| 9 | AKENYGKTL | 11 |
| 1 | GDLPKGREA | 6 |
| | V2-(SET3)-HLA-B2709-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 10 |
| 9 | KYAGLYDDI | 10 |
| 8 | GKYAGLYDD | 6 |
| 6 | GEGKYAGLY | 4 |
| | V3-HLA-B2709-9mers-282P1G3 Each peptide is a portion of SEQ ID NO: 7; each start position is specified, the length of peptide is 9 amino acids, and the end position for each peptide is the start position plus eight. | |
| 43 | NRNMLAEDF | 19 |
| 39 | LSYRNRNML | 12 |
| 44 | RNMLAEDFI | 12 |

TABLE XXXI-continued

| Pos | 123456789 | score |
|---|---|---|
| 22 | ATGSPQPSI | 11 |
| 24 | GSPQPSIFI | 11 |
| 31 | FICSKEQEL | 11 |
| 41 | YRNRNMLAE | 11 |
| 11 | TYVSNTTYV | 10 |
| 5 | VDVINTTYV | 9 |
| 23 | TGSPQPSIF | 9 |
| 38 | ELSYRNRNM | 9 |
| 59 | NYVEKSSTF | 9 |
| 62 | EKSSTFFKI | 9 |
| 53 | QKSTSCNYV | 8 |
| 60 | YVEKSSTFF | 8 |
| | V4-HLA-B2709-9mers-282P1G3 Each peptide is a portion of SEQ ID NO: 9; each start position is specified, the length of peptide is 9 amino acids, and the end position for each peptide is the start position plus eight. | |
| 1 | VTLYSGEDL | 12 |
| 7 | EDLPEQPTF | 12 |
| 8 | DLPEQPTFL | 10 |
| | V5-HLA-B2709-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 9 |
| 3 | KLTVNSSNS | 4 |
| | V6-HLA-B2709-9mers-282P1G3 Each peptide is a portion of SEQ ID NO: 13; each start position is specified, the length of peptide is 9 amino acids, and the end position for each peptide is the start position plus eight. | |
| 2 | EIEFIVPKL | 13 |
| 5 | FIVPKLEHI | 10 |
| | V7-HLA-B2709-9mers-282P1G3 Each peptide is a portion of SEQ ID NO: 15; each start position is specified, the length of peptide is 9 amino acids, and the end position for each peptide is the start position plus eight. | |
| 7 | VEDNISHEL | 11 |
| 3 | FHVIVEDNI | 10 |
| 10 | NISHELFTL | 10 |
| 8 | EDNISHELF | 8 |

TABLE XXXII

| Pos | 123456789 | score |
|---|---|---|
| | V1-HLA-B4402-9mers-282P1G3 Each peptide is a portion of SEQ ID NO: 3; each start position is specified, the length of peptide is 9 amino acids, and the end position for each peptide is the start position plus eight. | |
| 194 | EEKDSRNDY | 25 |
| 271 | GEILLLECF | 25 |
| 670 | EEPGRWEEL | 25 |
| 143 | VEEGDPIVL | 24 |
| 372 | GEPQPTIKW | 24 |
| 778 | EETVTNHTL | 24 |
| 976 | YEIGELNDI | 24 |
| 482 | LEGRRYHIY | 23 |
| 1156 | DEKPLKGSL | 23 |
| 370 | AEGEPQPTI | 22 |
| 552 | CESKCDSHL | 21 |
| 206 | AAFPRLRTI | 20 |
| 258 | TESGSESSI | 20 |
| 121 | EEIEFIVPS | 19 |
| 617 | ADITQVTVL | 19 |
| 25 | IEIPSSVQQ | 18 |
| 141 | LEVEEGDPI | 18 |
| 144 | EEGDPIVLP | 18 |
| 344 | EEPPRWTKK | 18 |
| 537 | PKNPRIPKL | 18 |
| 540 | PRIPKLHML | 18 |
| 157 | KGLPPLHIY | 17 |
| 396 | VVFPREISF | 17 |
| 525 | LDIRNATKL | 17 |
| 580 | TEDGRIIID | 17 |
| 903 | EFHLTVLAY | 17 |
| 1105 | AIALLTLLL | 17 |
| 1193 | EDGSFIGAY | 17 |
| 262 | SESSITILK | 16 |
| 268 | ILKGEILLL | 16 |
| 280 | AEGLPTPQV | 16 |
| 400 | REISFTNLQ | 16 |
| 465 | ASPEAVVSW | 16 |
| 657 | NISEYIVEF | 16 |
| 676 | EELTRVQGK | 16 |
| 684 | KKTTVILPL | 16 |
| 810 | GPDPQSVTL | 16 |
| 893 | GMVPSLDAF | 16 |
| 902 | SEFHLTVLA | 16 |
| 929 | EGVPEQPTF | 16 |
| 932 | PEQPTFLKV | 16 |
| 933 | EQPTFLKVI | 16 |
| 979 | GELNDINIT | 16 |
| 1139 | PEIQSVKDE | 16 |
| 2 | EPLLLGRGL | 15 |
| 6 | LGRGLIVYL | 15 |
| 39 | KQSKVQVAF | 15 |
| 45 | VAFPFDEYF | 15 |
| 59 | AKGNPEPTF | 15 |
| 92 | FRIPNEGHI | 15 |
| 118 | AMSEEIEFI | 15 |
| 125 | FIVPSVPKL | 15 |
| 158 | GLPPLHIYW | 15 |
| 169 | IELEHIEQD | 15 |
| 246 | IKQRKPKLL | 15 |
| 343 | VEEPPRWTK | 15 |
| 450 | ATVVGYSAF | 15 |
| 575 | FEINGTEDG | 15 |
| 628 | PDPPENLHL | 15 |
| 638 | ERQNRSVRL | 15 |
| 669 | KEEPGRWEE | 15 |
| 687 | TVILPLAPF | 15 |
| 726 | APDRNRQNI | 15 |
| 740 | QPKEMIIKW | 15 |
| 743 | EMIIKWEPL | 15 |
| 777 | EEETVTNHT | 15 |
| 799 | VKVQAINQL | 15 |

TABLE XXXII-continued

| Pos | 123456789 | score |
|---|---|---|
| 853 | RVHGRLKGY | 15 |
| 878 | PKEVNILRF | 15 |
| 879 | KEVNILRFS | 15 |
| 920 | SEPYIFQTP | 15 |
| 950 | LSWGLPKKL | 15 |
| 961 | NLTGYLLQY | 15 |
| 997 | SNLNATTKY | 15 |
| 1030 | EGSKGIGKI | 15 |
| 1057 | AEHIVRLMT | 15 |
| 1100 | IGLMCAIAL | 15 |
| 1101 | GLMCAIALL | 15 |
| 1104 | CAIALLTLL | 15 |
| 1106 | IALLTLLLL | 15 |
| 1175 | ESADSLVEY | 15 |
| 1192 | SEDGSFIGA | 15 |
| 5 | LLGRGLIVY | 14 |
| 9 | GLIVYLMFL | 14 |
| 11 | IVYLMFLLL | 14 |
| 13 | YLMFLLLKF | 14 |
| 70 | TKDGNPFYF | 14 |
| 84 | IPSNNSGTF | 14 |
| 95 | PNEGHISHF | 14 |
| 120 | SEEIEFIVP | 14 |
| 123 | IEFIVPSVP | 14 |
| 151 | LPCNPPKGL | 14 |
| 200 | NDYCCFAAF | 14 |
| 237 | TEIGSKANS | 14 |
| 266 | ITILKGEIL | 14 |
| 303 | TKENYGKTL | 14 |
| 305 | ENYGKTLKI | 14 |
| 350 | TKKPQSAVY | 14 |
| 359 | STGSNGILL | 14 |
| 390 | HPFAGDVVF | 14 |
| 407 | LQPNHTAVY | 14 |
| 447 | ENYATVVGY | 14 |
| 456 | SAFLHCEFF | 14 |
| 487 | YHIYENGTL | 14 |
| 512 | VENAIGKTA | 14 |
| 558 | SHLKHSLKL | 14 |
| 567 | SWSKDGEAF | 14 |
| 572 | GEAFEINGT | 14 |
| 599 | LEDQGIYCC | 14 |
| 637 | SERQNRSVR | 14 |
| 653 | DHNSNISEY | 14 |
| 663 | VEFEGNKEE | 14 |
| 675 | WEELTRVQG | 14 |
| 720 | HETPPAAPD | 14 |
| 738 | ASQPKEMII | 14 |
| 755 | EQNGPGLEY | 14 |
| 759 | PGLEYRVTW | 14 |
| 768 | KPQGAPVEW | 14 |
| 838 | NSTLVKVTW | 14 |
| 858 | LKGYQINWW | 14 |
| 942 | KVDKDTATL | 14 |
| 944 | DKDTATLSW | 14 |
| 957 | KLNGNLTGY | 14 |
| 973 | NDTYEIGEL | 14 |
| 1000 | NATTKYKFY | 14 |
| 1023 | EESSTLGEG | 14 |
| 1045 | QKTHPIEVF | 14 |
| 1055 | PGAEHIVRL | 14 |
| 1060 | IVRLMTKNW | 14 |
| 1094 | STQGWFIGL | 14 |
| 1098 | WFIGLMCAI | 14 |
| 1110 | TLLLLTVCF | 14 |
| 1132 | KEDLHPDPE | 14 |
| 1 | MEPLLLGRG | 13 |
| 17 | LLLKFSKAI | 13 |
| 50 | DEYFQIECE | 13 |
| 63 | PEPTFSWTK | 13 |
| 96 | NEGHISHFQ | 13 |
| 133 | LPKEKIDPL | 13 |
| 135 | KEKIDPLEV | 13 |
| 154 | NPPKGLPPL | 13 |
| 174 | IEQDERVYM | 13 |
| 203 | CCFAAFPRL | 13 |
| 219 | PMKLTVNSL | 13 |

TABLE XXXII-continued

| Pos | 123456789 | score |
|---|---|---|
| 245 | SIKQRKPKL | 13 |
| 247 | KQRKPKLLL | 13 |
| 261 | GSESSITIL | 13 |
| 267 | TILKGEILL | 13 |
| 282 | GLPTPQVDW | 13 |
| 331 | FLGTATHDF | 13 |
| 417 | CEASNVHGT | 13 |
| 418 | EASNVHGTI | 13 |
| 419 | ASNVHGTIL | 13 |
| 446 | GENYATVVG | 13 |
| 474 | QKVEEVKPL | 13 |
| 477 | EEVKPLEGR | 13 |
| 479 | VKPLEGRRY | 13 |
| 502 | EEDAGSYSC | 13 |
| 503 | EDAGSYSCW | 13 |
| 584 | RIIIDGANL | 13 |
| 591 | NLTISNVTL | 13 |
| 626 | DVPDPPENL | 13 |
| 640 | QNRSVRLTW | 13 |
| 690 | LPLAPFVRY | 13 |
| 692 | LAPFVRYQF | 13 |
| 706 | NEVGRSQPS | 13 |
| 742 | KEMIIKWEP | 13 |
| 754 | MEQNGPGLE | 13 |
| 761 | LEYRVTWKP | 13 |
| 811 | PDPQSVTLY | 13 |
| 821 | GEDYPDTAP | 13 |
| 829 | PVIHGVDVI | 13 |
| 833 | GVDVINSTL | 13 |
| 863 | INWWKTKSL | 13 |
| 876 | THPKEVNIL | 13 |
| 890 | RNSGMVPSL | 13 |
| 896 | PSLDAFSEF | 13 |
| 915 | GAGPESEPY | 13 |
| 959 | NGNLTGYLL | 13 |
| 970 | QIINDTYEI | 13 |
| 986 | ITTPSKPSW | 13 |
| 991 | KPSWHLSNL | 13 |
| 1001 | ATTKYKFYL | 13 |
| 1050 | IEVFEPGAE | 13 |
| 1053 | FEPGAEHIV | 13 |
| 1067 | NWGDNDSIF | 13 |
| 1078 | VIETRGREY | 13 |
| 1091 | DDISTQGWF | 13 |
| 1103 | MCAIALLTL | 13 |
| 1119 | VKRNRGGKY | 13 |
| 1130 | KEKEDLHPD | 13 |
| 1152 | YSDSDEKPL | 13 |
| 1159 | PLKGSLRSL | 13 |
| 1174 | TESADSLVE | 13 |
| 1182 | EYGEGDHGL | 13 |
| 1205 | KEKGSVESN | 13 |
| 1210 | VESNGSSTA | 13 |
| 1212 | SNGSSTATF | 13 |
| 1214 | GSSTATFPL | 13 |
| 3 | PLLLGRGLI | 12 |
| 8 | RGLIVYLMF | 12 |
| 19 | LKFSKAIEI | 12 |
| 41 | SKVQVAFPF | 12 |
| 47 | FPFDEYFQI | 12 |
| 61 | GNPEPTFSW | 12 |
| 68 | SWTKDGNPF | 12 |
| 76 | FYFTDHRII | 12 |
| 99 | HISHFQGKY | 12 |
| 102 | HFQGKYRCF | 12 |
| 107 | YRCFASNKL | 12 |
| 117 | IAMSEEIEF | 12 |
| 173 | HIEQDERVY | 12 |
| 181 | YMSQKGDLY | 12 |
| 214 | IVQKMPMKL | 12 |
| 238 | EIGSKANSI | 12 |
| 260 | SGSESSITI | 12 |
| 304 | KENYGKTLK | 12 |
| 323 | NYRCTASNF | 12 |
| 324 | YRCTASNFL | 12 |
| 384 | GSPVDNHPF | 12 |
| 424 | GTILANANI | 12 |

TABLE XXXII-continued

| Pos | 123456789 | score |
|---|---|---|
| 432 | IDVVDVRPL | 12 |
| 461 | CEFFASPEA | 12 |
| 476 | VEEVKPLEG | 12 |
| 489 | IYENGTLQI | 12 |
| 490 | YENGTLQIN | 12 |
| 534 | RVSPKNPRI | 12 |
| 542 | IPKLHMLEL | 12 |
| 548 | LELHCESKC | 12 |
| 556 | CDSHLKHSL | 12 |
| 569 | SKDGEAFEI | 12 |
| 586 | IIDGANLTI | 12 |
| 605 | YCCSAHTAL | 12 |
| 631 | PENLHLSER | 12 |
| 648 | WEAGADHNS | 12 |
| 650 | AGADHNSNI | 12 |
| 682 | QGKKTTVIL | 12 |
| 748 | WEPLKSMEQ | 12 |
| 753 | SMEQNGPGL | 12 |
| 786 | LRVMTPAVY | 12 |
| 796 | PYDVKVQAI | 12 |
| 823 | DYPDTAPVI | 12 |
| 850 | PKDRVHGRL | 12 |
| 857 | RLKGYQINW | 12 |
| 864 | NWWKTKSLL | 12 |
| 875 | RTHPKEVNI | 12 |
| 901 | FSEFHLTVL | 12 |
| 916 | AGPESEPYI | 12 |
| 918 | PESEPYIFQ | 12 |
| 930 | GVPEQPTFL | 12 |
| 958 | LNGNLTGYL | 12 |
| 968 | QYQIINDTY | 12 |
| 999 | LNATTKYKF | 12 |
| 1022 | TEESSTLGE | 12 |
| 1052 | VFEPGAEHI | 12 |
| 1079 | IETRGREYA | 12 |
| 1082 | RGREYAGLY | 12 |
| 1090 | YDDISTQGW | 12 |
| 1141 | IQSVKDETF | 12 |
| 1144 | VKDETFGEY | 12 |
| 1183 | YGEGDHGLF | 12 |
| 1184 | GEGDHGLFS | 12 |
| 1189 | GLFSEDGSF | 12 |

V2-(SET1)-HLA-B4402-9mers-282P1G3

Each peptide is a portion of SEQ ID NO: 5; each start position is specified, the length of peptide is 9 amino acids, and the end position for each peptide is the start position plus eight.

| Pos | 123456789 | score |
|---|---|---|
| 1 | FIVPSVPKF | 15 |
| 9 | FPKEKIDPL | 13 |
| 6 | VPKFPKEKI | 9 |
| 7 | PKFPKEKID | 7 |

V2-(SET2)-HLA-B4402-9mers-282P1G3

Each peptide is a portion of SEQ ID NO: 5; each start position is specified, the length of peptide is 9 amino acids, and the end position for each peptide is the start position plus eight.

| Pos | 123456789 | score |
|---|---|---|
| 9 | AKENYGKTL | 17 |
| 5 | KGREAKENY | 11 |
| 7 | REAKENYGK | 10 |

V2-(SET3)-HLA-B4402-9mers-282P1G3

TABLE XXXII-continued

| Pos | 123456789 | score |
|---|---|---|
| | Each peptide is a portion of SEQ ID NO: 5; each start position is specified the length of peptide is 9 amino acids, and the end position for each peptide is the start position plus eight. | |
| 6 | GEGKYAGLY | 22 |
| 2 | SSTLGEGKY | 13 |
| 5 | LGEGKYAGL | 11 |
| 9 | KYAGLYDDI | 10 |
| | V3-HLA-B4402-9mers-282P1G3 Each peptide is a portion of SEQ ID NO: 7; each start position is specified, the length of peptide is 9 amino acids, and the end position for each peptide is the start position plus eight. | |
| 48 | AEDFIQKST | 17 |
| 23 | TGSPQPSIF | 15 |
| 39 | LSYRNRNML | 14 |
| 4 | GVDVINTTY | 13 |
| 37 | QELSYRNRN | 13 |
| 62 | EKSSTFFKI | 13 |
| 43 | NRNMLAEDF | 12 |
| 59 | NYVEKSSTF | 12 |
| 10 | TTYVSNTTY | 11 |
| 22 | ATGSPQPSI | 11 |
| 33 | CSKEQELSY | 11 |
| 35 | KEQELSYRN | 11 |
| 61 | VEKSSTFFK | 11 |
| 24 | GSPQPSIFI | 10 |
| 31 | FICSKEQEL | 10 |
| 44 | RNMLAEDFI | 10 |
| 52 | IQKSTSCNY | 10 |
| 60 | YVEKSSTFF | 10 |
| | V4-HLA-B4402-9mers-282P1G3 Each peptide is a portion of SEQ ID NO: 9; each start position is specified, the length of peptide is 9 amino acids, and the end position for each peptide is the start position plus eight. | |
| 7 | EDLPEQPTF | 17 |
| 6 | GEDLPEQPT | 12 |
| 8 | DLPEQPTFL | 12 |
| 1 | VTLYSGEDL | 11 |
| | V5-HLA-B4402-9mers-282P1G3 Each peptide is a portion of SEQ ID NO: 11; each start position is specified, the length of peptide is 9 amino acids, and the end position for each peptide is the start position plus eight. | |
| 4 | LTVNSSNSI | 10 |
| 7 | NSSNSIKQR | 9 |
| 6 | VNSSNSIKQ | 4 |
| 9 | SNSIKQRKP | 4 |
| | V6-HLA-B4402-9mers-282P1G3 Each peptide is a portion of SEQ ID NO: 13; each start position is specified, the length of peptide is 9 amino acids, and the end position for each peptide is the start position plus eight. | |
| 1 | EEIEFIVPK | 19 |
| 3 | IEFIVPKLE | 16 |
| 2 | EIEFIVPKL | 15 |
| 5 | FIVPKLEHI | 12 |
| | V7-HLA-B4402-9mers-282P1G3 Each peptide is a portion of SEQ ID NO: 15; each start position is specified, the length of peptide is 9 amino acids, and the end position for each peptide is the start position plus eight. | |
| 7 | VEDNISHEL | 24 |
| 20 | PEPPRWTKK | 16 |
| 10 | NISHELFTL | 14 |
| 17 | TLHPEPPRW | 14 |
| 8 | EDNISHELF | 13 |
| 13 | HELFTLHPE | 13 |

TABLE XXXIIII

| Pos | 123456789 | score |
|---|---|---|
| | V1-HLA-B5101-9mers-282P1G3 Each peptide is a portion of SEQ ID NO: 3; each start position is specified, the length of peptide is 9 amino acids, and the end position for each peptide is the start position plus eight. | |
| 611 | TALDSAADI | 26 |
| 206 | AAFPRLRTI | 25 |
| 334 | TATHDFHVI | 25 |
| 427 | LANANIDVV | 25 |
| 285 | TPQVDWNKI | 24 |
| 418 | EASNVHGTI | 24 |
| 445 | DGENYATVV | 24 |
| 519 | TAVTANLDI | 24 |
| 47 | FPFDEYFQI | 23 |
| 130 | VPKLPKEKI | 23 |
| 504 | DAGSYSCWV | 23 |
| 1106 | IALLTLLLL | 23 |
| 133 | LPKEKIDPL | 22 |
| 260 | SGSESSITI | 22 |
| 429 | NANIDVVDV | 22 |
| 616 | AADITQVTV | 22 |
| 23 | KAIEIPSSV | 21 |
| 468 | EAVVSWQKV | 21 |
| 726 | APDRNPQNI | 21 |
| 823 | DYPDTAPVI | 21 |
| 873 | DGRTHPKEV | 21 |
| 963 | TGYLLQYQI | 21 |
| 115 | LGIAMSEEI | 20 |
| 139 | DPLEVEEGD | 20 |
| 151 | LPCNPPKGL | 20 |
| 154 | NPPKGLPPL | 20 |
| 578 | NGTEDGRII | 20 |
| 589 | GANLTISNV | 20 |
| 737 | QASQPKEMI | 20 |
| 916 | AGPESEPYI | 20 |

TABLE XXXIIII-continued

| Pos | 123456789 | score |
|---|---|---|
| 954 | LPKKLNGNL | 20 |
| 1030 | EGSKGIGKI | 20 |
| 1172 | QPTESADSL | 20 |
| 2 | EPLLLGRGL | 19 |
| 305 | ENYGKTLKI | 19 |
| 542 | IPKLHMLEL | 19 |
| 791 | PAVYAPYDV | 19 |
| 794 | YAPYDVKVQ | 19 |
| 810 | GPDPQSVTL | 19 |
| 828 | APVIHGVDV | 19 |
| 978 | IGELNDINI | 19 |
| 988 | TPSKPSWHL | 19 |
| 1104 | CAIALLTLL | 19 |
| 1136 | HPDPEIQSV | 19 |
| 629 | DPPENLHLS | 18 |
| 650 | AGADHNSNI | 18 |
| 690 | LPLAPFVRY | 18 |
| 757 | NGPGLEYRV | 18 |
| 795 | APYDVKVQA | 18 |
| 1100 | IGLMCAIAL | 18 |
| 6 | LGRGLIVYL | 17 |
| 27 | IPSSVQQVP | 17 |
| 433 | DVVDVRPLI | 17 |
| 586 | IIDGANLTI | 17 |
| 681 | VQGKKTTVI | 17 |
| 740 | QPKEMIIKW | 17 |
| 812 | DPQSVTLYS | 17 |
| 855 | HGRLKGYQI | 17 |
| 909 | LAYNSKGAG | 17 |
| 933 | EQPTFLKVI | 17 |
| 991 | KPSWHLSNL | 17 |
| 1033 | KGIGKISGV | 17 |
| 1055 | PGAEHIVRL | 17 |
| 1138 | DPEIQSVKD | 17 |
| 17 | LLLKFSKAI | 16 |
| 19 | LKFSKAIEI | 16 |
| 75 | PFYFTDHRI | 16 |
| 185 | KGDLYFANV | 16 |
| 297 | LPKGRETKE | 16 |
| 390 | HPFAGDVVF | 16 |
| 392 | FAGDVVFPR | 16 |
| 464 | FASPEAVVS | 16 |
| 514 | NAIGKTAVT | 16 |
| 573 | EAFEINGTE | 16 |
| 695 | FVRYQFRVI | 16 |
| 877 | HPKEVNILR | 16 |
| 899 | DAFSEFHLT | 16 |
| 1035 | IGKISGVNL | 16 |
| 1199 | GAYAGSKEK | 16 |
| 11 | IVYLMFLLL | 15 |
| 94 | IPNEGHISH | 15 |
| 147 | DPIVLPCNP | 15 |
| 208 | FPRLRTIVQ | 15 |
| 375 | QPTIKWRVN | 15 |
| 398 | FPREISFTN | 15 |
| 466 | SPEAVVSWQ | 15 |
| 480 | KPLEGRRYH | 15 |
| 508 | YSCWVENAI | 15 |
| 614 | DSAADITQV | 15 |
| 682 | QGKKTTVIL | 15 |
| 692 | LAPFVRYQF | 15 |
| 703 | IAVNEVGRS | 15 |
| 722 | TPPAAPDRN | 15 |
| 728 | DRNPQNIRV | 15 |
| 824 | YPDTAPVIH | 15 |
| 826 | DTAPVIHGV | 15 |
| 827 | TAPVIHGVD | 15 |
| 829 | PVIHGVDVI | 15 |
| 921 | EPYIFQTPE | 15 |
| 927 | TPEGVPEQP | 15 |
| 935 | PTFLKVIKV | 15 |
| 976 | YEIGELNDI | 15 |
| 1048 | HPIEVFEPG | 15 |
| 1054 | EPGAEHIVR | 15 |
| 1092 | DISTQGWFI | 15 |
| 1111 | LLLLTVCFV | 15 |
| 1158 | KPLKGSLRS | 15 |

TABLE XXXIIII-continued

| Pos | 123456789 | score |
|---|---|---|
| 1202 | AGSKEKGSV | 15 |
| 4 | LLLGRGLIV | 14 |
| 29 | SSVQQVPTI | 14 |
| 30 | SVQQVPTII | 14 |
| 64 | EPTFSWTKD | 14 |
| 76 | FYFTDHRII | 14 |
| 84 | IPSNNSGTF | 14 |
| 141 | LEVEEGDPI | 14 |
| 159 | LPPLHIYWM | 14 |
| 255 | LPPTESGSE | 14 |
| 279 | FAEGLPTPQ | 14 |
| 283 | LPTPQVDWN | 14 |
| 327 | TASNFLGTA | 14 |
| 345 | EPPRWTKKP | 14 |
| 370 | AEGEPQPTI | 14 |
| 449 | YATVVGYSA | 14 |
| 453 | VGYSAFLHC | 14 |
| 527 | IRNATKLRV | 14 |
| 577 | INGTEDGRI | 14 |
| 615 | SAADITQVT | 14 |
| 619 | ITQVTVLDV | 14 |
| 673 | GRWEELTRV | 14 |
| 749 | EPLKSMEQN | 14 |
| 758 | GPGLEYRVT | 14 |
| 759 | PGLEYRVTW | 14 |
| 836 | VINSTLVKV | 14 |
| 849 | VPKDRVHGR | 14 |
| 887 | SGQRNSGMV | 14 |
| 950 | LSWGLPKKL | 14 |
| 959 | NGNLTGYLL | 14 |
| 1000 | NATTKYKFY | 14 |
| 1027 | TLGEGSKGI | 14 |
| 1071 | NDSIFQDVI | 14 |
| 1108 | LLTLLLLTV | 14 |
| 1190 | LFSEDGSFI | 14 |
| 1201 | YAGSKEKGS | 14 |
| 62 | NPEPTFSWT | 13 |
| 74 | NPFYFTDHR | 13 |
| 110 | FASNKLGIA | 13 |
| 117 | IAMSEEIEF | 13 |
| 118 | AMSEEIEFI | 13 |
| 143 | VEEGDPIVL | 13 |
| 156 | PKGLPPLHI | 13 |
| 163 | HIYWMNIEL | 13 |
| 205 | FAAFPRLRT | 13 |
| 214 | IVQKMPMKL | 13 |
| 218 | MPMKLTVNS | 13 |
| 238 | EIGSKANSI | 13 |
| 256 | PPTESGSES | 13 |
| 258 | TESGSESSI | 13 |
| 281 | EGLPTPQVD | 13 |
| 357 | VYSTGSNGI | 13 |
| 373 | EPQPTIKWR | 13 |
| 388 | DNHPFAGDV | 13 |
| 389 | NHPFAGDVV | 13 |
| 408 | QPNHTAVYQ | 13 |
| 438 | RPLIQTKDG | 13 |
| 471 | VSWQKVEEV | 13 |
| 489 | IYENGTLQI | 13 |
| 522 | TANLDIRNA | 13 |
| 529 | NATKLRVSP | 13 |
| 534 | RVSPKNPRI | 13 |
| 539 | NPRIPKLHM | 13 |
| 617 | ADITQVTVL | 13 |
| 626 | DVPDPPENL | 13 |
| 680 | RVQGKKTTV | 13 |
| 715 | QPSDHHETP | 13 |
| 725 | AAPDRNPQN | 13 |
| 768 | KPQGAPVEW | 13 |
| 790 | TPAVYAPYD | 13 |
| 793 | VYAPYDVKV | 13 |
| 796 | PYDVKVQAI | 13 |
| 841 | LVKVTWSTV | 13 |
| 900 | AFSEFHLTV | 13 |
| 923 | YIFQTPEGV | 13 |
| 932 | PEQPTFLKV | 13 |
| 1013 | TSQGCGKPI | 13 |

TABLE XXXIIII-continued

| Pos | 123456789 | score |
|---|---|---|
| 1052 | VFEPGAEHI | 13 |
| 1056 | GAEHIVRLM | 13 |
| 1066 | KNWGDNDSI | 13 |
| 1070 | DNDSIFQDV | 13 |
| 1086 | YAGLYDDIS | 13 |
| 3 | PLLLGRGLI | 12 |
| 26 | EIPSSVQQV | 12 |
| 37 | IIKQSKVQV | 12 |
| 45 | VAFPFDEYF | 12 |
| 58 | EAKGNPEPT | 12 |
| 72 | DGNPFYFTD | 12 |
| 92 | FRIPNEGHI | 12 |
| 125 | FIVPSVPKL | 12 |
| 127 | VPSVPKLPK | 12 |
| 155 | PPKGLPPLH | 12 |
| 160 | PPLHIYWMN | 12 |
| 166 | WMNIELEHI | 12 |
| 190 | FANVEEKDS | 12 |
| 216 | QKMPMKLTV | 12 |
| 229 | HANDSSSST | 12 |
| 346 | PPRWTKKPQ | 12 |
| 352 | KPQSAVYST | 12 |
| 369 | EAEGEPQPT | 12 |
| 394 | GDVVFPREI | 12 |
| 426 | ILANANIDV | 12 |
| 444 | KDGENYATV | 12 |
| 462 | EFFASPEAV | 12 |
| 463 | FFASPEAVV | 12 |
| 481 | PLEGRRYHI | 12 |
| 516 | IGKTAVTAN | 12 |
| 525 | LDIRNATKL | 12 |
| 558 | SHLKHSLKL | 12 |
| 569 | SKDGEAFEI | 12 |
| 571 | DGEAFEING | 12 |
| 579 | GTEDGRIII | 12 |
| 591 | NLTISNVTL | 12 |
| 608 | SAHTALDSA | 12 |
| 627 | VPDPPENLH | 12 |
| 636 | LSERQNRSV | 12 |
| 649 | EAGADHNSN | 12 |
| 688 | VILPLAPFV | 12 |
| 700 | FRVIAVNEV | 12 |
| 723 | PPAAPDRNP | 12 |
| 730 | NPQNIRVQA | 12 |
| 772 | APVEWEEET | 12 |
| 822 | EDYPDTAPV | 12 |
| 875 | RTHPKEVNI | 12 |
| 876 | THPKEVNIL | 12 |
| 895 | VPSLDAFSE | 12 |
| 901 | FSEFHLTVL | 12 |
| 947 | TATLSWGLP | 12 |
| 964 | GYLLQYQII | 12 |
| 1010 | RACTSQGCG | 12 |
| 1015 | QGCGKPITE | 12 |
| 1042 | NLTQKTHPI | 12 |
| 1044 | TQKTHPIEV | 12 |
| 1133 | EDLHPDPEI | 12 |
| 1176 | SADSLVEYG | 12 |
| | V2-HLA-B5101-9mers-(SET1)-282P1G3 Each peptide is a portion of SEQ ID NO: 5; each start position is specified, the length of peptide is 9 amino acids, and the end position for each peptide is the start position plus eight. | |
| 6 | VPKFPKEKI | 23 |
| 9 | FPKEKIDPL | 21 |
| 3 | VPSVPKFPK | 11 |
| | V2-(SET2)-HLA-B5101-9mers-282P1G3 Each peptide is a portion of SEQ ID NO: 5; each start position is specified, the length of peptide is 9 amino acids, and the end position for each peptide is the start position plus eight. | |
| 3 | LPKGREAKE | 15 |
| 8 | EAKENYGKT | 14 |
| 9 | AKENYGKTL | 10 |
| 5 | KGREAKENY | 8 |
| | V2-(SET3)-HLA-B5101-9mers-282P1G3 Each peptide is a portion of SEQ ID NO: 5; each start position is specified, the length of peptide is 9 amino acids, and the end position for each peptide is the start position plus eight. | |
| 5 | LGEGKYAGL | 16 |
| 9 | KYAGLYDDI | 11 |
| 7 | EGKYAGLYD | 7 |
| | V3-HLA-B5101-9mers-282P1G3 Each peptide is a portion of SEQ ID NO: 7; each start position is specified, the length of peptide is 9 amino acids, and the end position for each peptide is the start position plus eight. | |
| 47 | LAEDFIQKS | 16 |
| 21 | NATGSPQPS | 14 |
| 62 | EKSSTFFKI | 14 |
| 3 | HGVDVINTT | 13 |
| 39 | LSYRNRNML | 13 |
| 24 | GSPQPSIFI | 12 |
| 25 | SPQPSIFIC | 12 |
| 27 | QPSIFICSK | 11 |
| 53 | QKSTSCNYV | 11 |
| 5 | VDVINTTYV | 10 |
| 10 | TTYVSNTTY | 10 |
| 11 | TYVSNTTYV | 10 |
| 22 | ATGSPQPSI | 10 |
| 44 | RNMLAEDFI | 10 |
| 16 | TTYVSNATG | 9 |
| 6 | DVINTTYVS | 8 |
| 23 | TGSPQPSIF | 8 |
| 31 | FICSKEQEL | 8 |
| | V4-HLA-B5101-9mers-282P1G3 Each peptide is a portion of SEQ ID NO: 9; each start position is specified, the length of peptide is 9 amino acids, and the end position for each peptide is the start position plus eight. | |
| 8 | DLPEQPTFL | 15 |
| 9 | LPEQPTFLK | 12 |
| 1 | VTLYSGEDL | 10 |
| 5 | SGEDLPEQP | 8 |
| | V5-HLA-B5101-9mers-282P1G3 Each peptide is a portion of SEQ ID NO: 11; each start position is specified, the length of peptide is 9 | |

TABLE XXXIIII-continued

| Pos | 123456789 | score |
|---|---|---|
| | amino acids, and the end position for each peptide is the start position plus eight. | |
| 4 | LTVNSSNSI | 14 |
| 2 | MKLTVNSSN | 7 |
| | V6-HLA-B5101-9mers-282P1G3 Each peptide is a portion of SEQ ID NO: 13; each start position is specified, the length of peptide is 9 amino acids, and the end position for each peptide is the start position plus eight. | |
| 5 | FIVPKLEHI | 14 |
| 7 | VPKLEHIEQ | 12 |
| 2 | EIEFIVPKL | 10 |
| 3 | IEFIVPKLE | 7 |
| | V7-HLA-85101-9mers-282P1G3 Each peptide is a portion of SEQ ID NO: 15; each start position is specified, the length of peptide is 9 amino acids, and the end position for each peptide is the start position plus eight. | |
| 3 | FHVIVEDNI | 13 |
| 19 | HPEPPRWTK | 12 |
| 10 | NISHELFTL | 10 |
| 7 | VEDNISHEL | 7 |
| 18 | LHPEPPRWT | 7 |
| 2 | DFHVIVEDN | 6 |
| 11 | ISHELFTLH | 6 |

TABLE XXXIV

| Pos | 1234567890 | score |
|---|---|---|
| | V1-HLA-A1-10mers-282P1G3 Each peptide is a portion of SEQ ID NO: 3; each start position is specified, the length of peptide is 10 amino acids, and the end position for each peptide is the start position plus nine. | |
| 810 | GPDPQSVTLY | 32 |
| 1192 | SEDGSFIGAY | 28 |
| 193 | VEEKDSRNDY | 27 |
| 481 | PLEGRRYHIY | 27 |
| 902 | SEFHLTVLAY | 24 |
| 1173 | PTESADSLVE | 23 |
| 4 | LLLGRGLIVY | 22 |
| 119 | MSEEIEFIVP | 22 |
| 309 | KTLKIENVSY | 22 |
| 349 | WTKKPQSAVY | 22 |
| 627 | VPDPPENLHL | 22 |
| 754 | MEQNGPGLEY | 22 |
| 931 | VPEQPTFLKV | 22 |
| 1021 | ITEESSTLGE | 22 |
| 1191 | FSEDGSFIGA | 22 |
| 406 | NLQPNHTAVY | 21 |
| 499 | RTTEEDAGSY | 21 |
| 919 | ESEPYIFQTP | 21 |

TABLE XXXIV-continued

| Pos | 1234567890 | score |
|---|---|---|
| 960 | GNLTGYLLQY | 21 |
| 996 | LSNLNATTKY | 21 |
| 261 | GSESSITILK | 20 |
| 371 | EGEPQPTIKW | 20 |
| 478 | EVKPLEGRRY | 20 |
| 579 | GTEDGRIIID | 20 |
| 788 | VMTPAVYAPY | 20 |
| 1143 | SVKDETFGEY | 20 |
| 1183 | YGEGDHGLFS | 20 |
| 43 | VQVAFPFDEY | 19 |
| 180 | VYMSQKGDLY | 19 |
| 689 | ILPLAPFVRY | 19 |
| 1118 | FVKRNRGGKY | 19 |
| 68 | SWTKDGNPFY | 18 |
| 236 | STEIGSKANS | 18 |
| 815 | SVTLYSGEDY | 18 |
| 1056 | GAEHIVRLMT | 18 |
| 1152 | YSDSDEKPLK | 18 |
| 78 | FTDHRIIPSN | 17 |
| 98 | GHISHFQGKY | 17 |
| 343 | VEEPPRWTKK | 17 |
| 500 | TTEEDAGSYS | 17 |
| 785 | TLRVMTPAVY | 17 |
| 824 | YPDTAPVIHG | 17 |
| 901 | FSEFHLTVLA | 17 |
| 1081 | TRGREYAGLY | 17 |
| 134 | PKEKIDPLEV | 16 |
| 172 | EHIEQDERVY | 16 |
| 257 | PTESGSESSI | 16 |
| 359 | STGSNGILLC | 16 |
| 440 | LIQTKDGENY | 16 |
| 446 | GENYATVVGY | 16 |
| 475 | KVEEVKPLEG | 16 |
| 569 | SKDGEAFEIN | 16 |
| 612 | ALDSAADITQ | 16 |
| 636 | LSERQNRSVR | 16 |
| 652 | ADHNSNISEY | 16 |
| 914 | KGAGPESEPY | 16 |
| 967 | LQYQIINDTY | 16 |
| 1028 | LGEGSKGIGK | 16 |
| 1077 | DVIETRGREY | 16 |
| 137 | KIDPLEVEEG | 15 |
| 142 | EVEEGDPIVL | 15 |
| 156 | PKGLPPLHIY | 15 |
| 298 | PKGRETKENY | 15 |
| 315 | NVSYQDKGNY | 15 |
| 434 | VVDVRPLIQT | 15 |
| 580 | TEDGRIIIDG | 15 |
| 596 | NVTLEDQGIY | 15 |
| 651 | GADHNSNISE | 15 |
| 852 | DRVHGRLKGY | 15 |
| 956 | KKLNGNLTGY | 15 |
| 999 | LNATTKYKFY | 15 |
| 1052 | VFEPGAEHIV | 15 |
| 1136 | HPDPEIQSVK | 15 |
| 1174 | TESADSLVEY | 15 |
| | V2-(SET1)-HLA-A1-10mers-282P1G3 Each peptide is a portion of SEQ ID NO: 5; each start position is specified, the length of peptide is 10 amino acids, and the end position for each peptide is the start position plus nine. | |
| 5 | PSVPKFPKEK | 8 |
| 8 | PKFPKEKIDP | 8 |
| 4 | VPSVPKFPKE | 6 |
| 2 | FIVPSVPKFP | 5 |
| 6 | SVPKFPKEKI | 4 |
| 1 | EFIVPSVPKF | 3 |
| 10 | FPKEKIDPLE | 3 |
| | V2-(SET2)-HLA-A1-10mers-282P1G3 Each peptide is a portion of | |

TABLE XXXIV-continued

| Pos | 1234567890 | score |
|---|---|---|
| | SEQ ID NO: 5; each start position is specified, the length of peptide is 10 amino acids, and the end position for each peptide is the start position plus nine. | |
| 5 | PKGREAKENY | 15 |
| 10 | AKENYGKTLK | 13 |
| 1 | GGDLPKGREA | 11 |
| 7 | GREAKENYGK | 11 |
| | V2-(SET3)-HLA-A1-10mers-282P1G3 Each peptide is a portion of SEQ ID NO: 5; each start position is specified, the length of peptide is 10 amino acids, and the end position for each peptide is the start position plus nine. | |
| 6 | LGEGKYAGLY | 28 |
| 2 | ESSTLGEGKY | 21 |
| | V3-HLA-A1-10mers-282P1G3 Each peptide is a portion of SEQ ID NO: 7; each start position is specified, the length of peptide is 10 amino acids, and the end position for each peptide is the start position plus nine. | |
| 10 | NTTYVSNTTY | 22 |
| 33 | ICSKEQELSY | 21 |
| 4 | HGVDVINTTY | 16 |
| 52 | FIQKSTSCNY | 16 |
| 26 | SPQPSIFICS | 13 |
| 35 | SKEQELSYRN | 12 |
| 61 | YVEKSSTFFK | 12 |
| 37 | EQELSYRNRN | 11 |
| 49 | AEDFIQKSTS | 11 |
| 56 | STSCNYVEKS | 11 |
| 5 | GVDVINTTYV | 10 |
| 48 | LAEDFIQKST | 10 |
| | V4-HLA-A1-10mers-282P1G3 Each peptide is a portion of SEQ ID NO: 9; each start position is specified, the length of peptide is 10 amino acids, and the end position for each peptide is the start position plus nine. | |
| 10 | LPEQPTELKV | 21 |
| 6 | SGEDLPEQPT | 12 |
| 7 | GEDLPEQPTF | 10 |
| | V5-HLA-A1-10mers-282P1G3 Each peptide is a portion of SEQ ID NO: 11; each start position is specified, the length of peptide is 10 amino acids, and the end position for each peptide is the start position plus nine. | |
| 9 | SSNSIKQRKP | 8 |
| 5 | LTVNSSNSIK | 7 |
| 6 | TVNSSNSIKQ | 6 |
| 8 | NSSNSIKQRK | 4 |
| 10 | SNSIKQRKPK | 3 |
| | V6-HLA-A1-10mers-282P1G3 Each peptide is a portion | |

TABLE XXXIV-continued

| Pos | 1234567890 | score |
|---|---|---|
| | of SEQ ID NO: 13; each start position is specified, the length of peptide is 10 amino acids, and the end position for each peptide is the start position plus nine. | |
| 1 | SEEIEFIVPK | 12 |
| 3 | EIEFIVPKLE | 12 |
| 10 | KLEHIEQDER | 11 |
| 4 | IEFIVPKLEH | 6 |
| 6 | FIVPKLEHIE | 5 |
| | V7-HLA-A1-10mers-282P1G3 Each peptide is a portion of SEQ ID NO: 15; each start position is specified, the length of peptide is 10 amino acids, and the end position for each peptide is the start position plus nine. | |
| 20 | HPEPPRWTKK | 16 |
| 8 | VEDNISHELF | 13 |
| 13 | SHELFTLHPE | 12 |
| 1 | THDFHVIVED | 10 |
| 7 | IVEDNISHEL | 10 |
| 12 | ISHELFTLHP | 10 |
| 17 | FTLHPEPPRW | 7 |

TABLE XXXV

| Pos | 1234567890 | score |
|---|---|---|
| | V1-HLA-A0201-10mers-282P1G3 Each peptide is a portion of SEQ ID NO: 3; each start position is specified, the length of peptide is 10 amino acids, and the end position for each peptide is the start position plus nine. | |
| 1107 | ALLTLLLLTV | 31 |
| 5 | LLGRGLIVYL | 28 |
| 426 | ILANANIDVV | 28 |
| 274 | LLLECFAEGL | 27 |
| 1102 | LMCAIALLTL | 27 |
| 1105 | AIALLTLLLL | 27 |
| 1110 | TLLLLTVCFV | 26 |
| 132 | KLPKEKIDPL | 25 |
| 267 | TILKGEILL | 25 |
| 585 | IIIDGANLTI | 24 |
| 635 | HLSERQNRSV | 24 |
| 957 | KLNGNLTGYL | 24 |
| 9 | GLIVYLMFLL | 23 |
| 615 | SAADITQVTV | 23 |
| 835 | DVINSTLVKV | 23 |
| 36 | TIIKQSKVQV | 22 |
| 118 | AMSEEIEFIV | 22 |
| 158 | GLPPLHIYWM | 22 |
| 431 | NIDVVDVRPL | 22 |
| 524 | NLDIRNATKL | 22 |
| 840 | TLVKVTWSTV | 22 |
| 897 | SLDAFSEFHL | 22 |
| 16 | FLLLKFSKAI | 21 |
| 114 | KLGIAMSEEI | 21 |
| 150 | VLPCNPPKGL | 21 |
| 470 | VVSWQKVEEV | 21 |
| 541 | RIPKLHMLEL | 21 |
| 618 | DITQVTVLDV | 21 |
| 792 | AVYAPYDVKV | 21 |

TABLE XXXV-continued

| Pos | 1234567890 | score |
|---|---|---|
| 875 | RTHPKEVNIL | 21 |
| 949 | TLSWGLPKKL | 21 |
| 953 | GLPKKLNGNL | 21 |
| 1034 | GIGKISGVNL | 21 |
| 3 | PLLLGRGLIV | 20 |
| 4 | LLLGRGLIVY | 20 |
| 10 | LIVYLMFLLL | 20 |
| 18 | LLKFSKAIEI | 20 |
| 25 | IEIPSSVQQV | 20 |
| 205 | FAAFPRLRTI | 20 |
| 213 | TIVQKMPMKL | 20 |
| 425 | TILANANIDV | 20 |
| 428 | ANANIDVVDV | 20 |
| 488 | HIYENGTLQI | 20 |
| 616 | AADITQVTVL | 20 |
| 862 | QINWWKTKSL | 20 |
| 966 | LLQYQIINDT | 20 |
| 1099 | FIGLMCAIAL | 20 |
| 1100 | IGLMCAIALL | 20 |
| 1189 | GLFSEDGSFI | 20 |
| 117 | IAMSEEIEFI | 19 |
| 206 | AAFPRLRTIV | 19 |
| 265 | SITILKGEIL | 19 |
| 1135 | LHPDPEIQSV | 19 |
| 1158 | KPLKGSLRSL | 19 |
| 121 | EEIEFIVPSV | 18 |
| 218 | MPMKLTVNSL | 18 |
| 245 | SIKQRKPKLL | 18 |
| 260 | SGSESSITIL | 18 |
| 266 | ITILKGEILL | 18 |
| 268 | ILKGEILLLE | 18 |
| 273 | ILLLECFAEG | 18 |
| 450 | ATVVGYSAFL | 18 |
| 526 | DIRNATKLRV | 18 |
| 536 | SPKNPRIPKL | 18 |
| 590 | ANLTISNVTL | 18 |
| 745 | IIKWEPLKSM | 18 |
| 765 | VTWKPQGAPV | 18 |
| 784 | HTLRVMTPAV | 18 |
| 889 | QRNSGMVPSL | 18 |
| 900 | AFSEFHLTVL | 18 |
| 965 | YLLQYQIIND | 18 |
| 972 | INDTYEIGEL | 18 |
| 1026 | STLGEGSKGI | 18 |
| 1043 | LTQKTHPIEV | 18 |
| 1112 | LLLTVCFVKR | 18 |
| 1201 | YAGSKEKGSV | 18 |
| 37 | IIKQSKVQVA | 17 |
| 82 | RIIPSNNSGT | 17 |
| 137 | KIDPLEVEEG | 17 |
| 153 | CNPPKGLPPL | 17 |
| 221 | KLTVNSLKHA | 17 |
| 253 | LLLPPTESGS | 17 |
| 279 | FAEGLPTPQV | 17 |
| 356 | AVYSTGSNGI | 17 |
| 413 | AVYQCEASNV | 17 |
| 565 | KLSWSKDGEA | 17 |
| 603 | GIYCCSAHTA | 17 |
| 687 | TVILPLAPFV | 17 |
| 696 | VRYQFRVIAV | 17 |
| 699 | QFRVIAVNEV | 17 |
| 795 | APYDVKVQAI | 17 |
| 798 | DVKVQAINQL | 17 |
| 809 | SGPDPQSVTL | 17 |
| 836 | VINSTLVKVT | 17 |
| 871 | LLDGRTHPKE | 17 |
| 899 | DAFSEFHLTV | 17 |
| 941 | IKVDKDTATL | 17 |
| 1032 | SKGIGKISGV | 17 |
| 1073 | SIFQDVIETR | 17 |
| 1101 | GLMCAIALLT | 17 |
| 1104 | CAIALLTLLL | 17 |
| 1106 | IALLTLLLLT | 17 |
| 8 | RGLIVYLMFL | 16 |
| 17 | LLLKFSKAIE | 16 |
| 22 | SKAIEIPSSV | 16 |
| 124 | EFIVPSVPKL | 16 |

TABLE XXXV-continued

| Pos | 1234567890 | score |
|---|---|---|
| 129 | SVPKLPKEKI | 16 |
| 254 | LLPPTESGSE | 16 |
| 326 | CTASNFLGTA | 16 |
| 333 | GTATHDFHVI | 16 |
| 365 | ILLCEAEGEP | 16 |
| 396 | VVFPREISFT | 16 |
| 421 | NVHGTILANA | 16 |
| 443 | TKDGENYATV | 16 |
| 514 | NAIGKTAVTA | 16 |
| 518 | KTAVTANLDI | 16 |
| 544 | KLHMLELHCE | 16 |
| 576 | EINGTEDGRI | 16 |
| 586 | IIDGANLTIS | 16 |
| 610 | HTALDSAADI | 16 |
| 613 | LDSAADITQV | 16 |
| 752 | KSMEQNGPGL | 16 |
| 772 | APVEWEEETV | 16 |
| 807 | LGSGPDPQSV | 16 |
| 827 | TAPVIHGVDV | 16 |
| 857 | RLKGYQINWW | 16 |
| 870 | SLLDGRTHPK | 16 |
| 915 | GAGPESEPYI | 16 |
| 937 | FLKVIKVDKD | 16 |
| 990 | SKPSWHLSNL | 16 |
| 1080 | ETRGREYAGL | 16 |
| 1094 | STQGWFIGLM | 16 |
| 1103 | MCAIALLTLL | 16 |
| 1166 | SLNRDMQPTE | 16 |
| 1181 | VEYGEGDHGL | 16 |
| 13 | YLMFLLLKFS | 15 |
| 141 | LEVEEGDPIV | 15 |
| 162 | LHIYWMNIEL | 15 |
| 165 | YWMNIELEHI | 15 |
| 179 | RVYMSQKGDL | 15 |
| 187 | DLYFANVEEK | 15 |
| 237 | TEIGSKANSI | 15 |
| 244 | NSIKQRKPKL | 15 |
| 252 | KLLLPPTESG | 15 |
| 282 | GLPTPQVDWN | 15 |
| 307 | YGKTLKIENV | 15 |
| 334 | TATHDFHVIV | 15 |
| 341 | VIVEEPPRWT | 15 |
| 458 | FLHCEFFASP | 15 |
| 464 | FASPEAVVSW | 15 |
| 515 | AIGKTAVTAN | 15 |
| 521 | VTANLDIRNA | 15 |
| 539 | NPRIPKLHML | 15 |
| 583 | GRIIIDGANL | 15 |
| 584 | RIIIDGANLT | 15 |
| 588 | DGANLTISNV | 15 |
| 598 | TLEDQGIYCC | 15 |
| 661 | YIVEFEGNKE | 15 |
| 683 | GKKTTVILPL | 15 |
| 702 | VIAVNEVGRS | 15 |
| 725 | AAPDRNPQNI | 15 |
| 830 | VIHGVDVINS | 15 |
| 833 | GVDVINSTLV | 15 |
| 948 | ATLSWGLPKK | 15 |
| 961 | NLTGYLLQYQ | 15 |
| 969 | YQIINDTYEI | 15 |
| 977 | EIGELNDINI | 15 |
| 980 | ELNDINITTP | 15 |
| 1019 | KPITEESSTL | 15 |
| 1029 | GEGSKGIGKI | 15 |
| 1037 | KISGVNLTQK | 15 |
| 1108 | LLTLLLLTVC | 15 |
| 1120 | KRNRGGKYSV | 15 |

V2-(SET1)-
HLA-A0201-10mers-
282P1G3

Each peptide is a portion of SEQ ID NO: 5; each start position is specified, the length of peptide is 10 amino acids, and the end position for each TABLE XXXV-continued

| Pos | 1234567890 | score |
| --- | --- | --- |
| | peptide is the start position plus nine. | |
| 6 | SVPKFPKEKI | 16 |
| 9 | KFPKEKIDPL | 15 |
| 2 | FIVPSVPKFP | 10 |
| | V2-(SET2)-HLA-A0201-10mers-282P1G3 Each peptide is a portion of SEQ ID NO: 5; each start position is specified, the length of peptide is 10 amino acids, and the end position for each peptide is the start position plus nine. | |
| 3 | DLPKGREAKE | 13 |
| 9 | EAKENYGKTL | 13 |
| 8 | REAKENYGKT | 8 |
| 1 | GGDLPKGREA | 7 |
| 2 | GDLPKGREAK | 6 |
| | V2-(SET3)-HLA-A0201-10mers-282P1G3 Each peptide is a portion of SEQ ID NO: 5; each start position is specified, the length of peptide is 10 amino acids, and the end position for each peptide is the start position plus nine. | |
| 3 | SSTLGEGKYA | 10 |
| 4 | STLGEGKYAG | 9 |
| 5 | TLGEGKYAGL | 8 |
| | V3-HLA-A0201-10mers-282P1G3 Each peptide is a portion of SEQ ID NO: 7; each start position is specified, the length of peptide is 10 amino acids, and the end position for each peptide is the start position plus nine. | |
| 47 | MLAEDFIQKS | 20 |
| 2 | VIHGVDVINT | 19 |
| 8 | VINTTYVSNT | 18 |
| 39 | ELSYRNRNML | 17 |
| 22 | NATGSPQPSI | 16 |
| 31 | IFICSKEQEL | 16 |
| 5 | GVDVINTTYV | 15 |
| 11 | TTYVSNTTYV | 15 |
| 3 | IHGVDVINTT | 13 |
| 53 | IQKSTSCNYV | 12 |
| 56 | STSCNYVEKS | 12 |
| 30 | SIFICSKEQE | 11 |
| 42 | YRNRNMLAED | 11 |
| 48 | LAEDFIQKST | 11 |
| 13 | YVSNTTYVSN | 10 |
| 14 | VSNTTYVSNA | 10 |
| 24 | TGSPQPSIFI | 10 |
| 46 | NMLAEDFIQK | 10 |
| 62 | VEKSSTFFKI | 10 |
| 7 | DVINTTYVSN | 9 |
| 32 | FICSKEQELS | 9 |
| 44 | NRNMLAEDFI | 9 |
| 52 | FIQKSTSCNY | 9 |
| | V4-HLA-A0201-10mers-282P1G3 Each peptide is a portion of SEQ ID NO: 9; each start position is specified, the length of peptide is 10 amino acids, and the end position for each peptide is the start position plus nine. | |
| 1 | SVTLYSGEDL | 15 |
| 10 | LPEQPTFLKV | 14 |
| 3 | TLYSGEDLPE | 12 |
| 4 | LYSGEDLPEQ | 11 |
| 8 | EDLPEQPTFL | 11 |
| 9 | DLPEQPTFLK | 11 |
| | V5-HLA-A0201-10mers-282P1G3 Each peptide is a portion of SEQ ID NO: 11; each start position is specified, the length of peptide is 10 amino acids, and the end position for each peptide is the start position plus nine. | |
| 4 | KLTVNSSNSI | 21 |
| | V6-HLA-A0201-10mers-282P1G3 Each peptide is a portion of SEQ ID NO: 13; each start position is specified, the length of peptide is 10 amino acids, and the end position for each peptide is the start position plus nine. | |
| 2 | EEIEFIVPKL | 18 |
| 6 | FIVPKLEHIE | 12 |
| 10 | KLEHIEQDER | 12 |
| 5 | EFIVPKLEHI | 11 |
| 7 | IVPKLEHIEQ | 8 |
| | V7-HLA-A0201-10mers-282P1G3 Each peptide is a portion of SEQ ID NO: 15; each start position is specified, the length of peptide is 10 amino acids, and the end position for each peptide is the start position plus nine. | |
| 7 | IVEDNISHEL | 19 |
| 10 | DNISHELFTL | 17 |
| 18 | TLHPEPPRWT | 16 |
| 6 | VIVEDNISHE | 15 |

TABLE XXXVI

| Pos | 1234567890 | score |
| --- | --- | --- |
| | V1-HLA-A0203-10mers-282P1G3 Each peptide is a portion of SEQ ID NO: 3; each start position is specified, the length of peptide is 10 amino acids, and the end position for each peptide is the start position plus nine. | |
| 198 | SRNDYCCFAA | 19 |
| 608 | SAHTALDSAA | 19 |
| 717 | SDHHETPPAA | 19 |
| 421 | NVHGTILANA | 18 |
| 643 | SVRLTWEAGA | 18 |
| 1098 | WFIGLMCAIA | 18 |
| 1193 | EDGSFIGAYA | 18 |
| 199 | RNDYCCFAAF | 17 |
| 609 | AHTALDSAAD | 17 |
| 718 | DHHETPPAAP | 17 |

TABLE XXXVI-continued

| Pos | 1234567890 | score |
|---|---|---|
| 15 | MFLLLKFSKA | 10 |
| 37 | IIKQSKVQVA | 10 |
| 50 | DEYFQIECEA | 10 |
| 102 | HFQGKYRCFA | 10 |
| 109 | CFASNKLGIA | 10 |
| 182 | MSQKGDLYFA | 10 |
| 197 | DSRNDYCCFA | 10 |
| 221 | KLTVNSLKHA | 10 |
| 234 | SSSTEIGSKA | 10 |
| 271 | GEILLLECFA | 10 |
| 319 | QDKGNYRCTA | 10 |
| 326 | CTASNFLGTA | 10 |
| 347 | PRWTKKPQSA | 10 |
| 361 | GSNGILLCEA | 10 |
| 384 | GSPVDNHPFA | 10 |
| 404 | FTNLQPNHTA | 10 |
| 410 | NHTAVYQCEA | 10 |
| 419 | ASNVHGTILA | 10 |
| 441 | IQTKDGENYA | 10 |
| 448 | NYATVVGYSA | 10 |
| 456 | SAFLHCEFFA | 10 |
| 460 | HCEFFASPEA | 10 |
| 496 | QINRTTEEDA | 10 |
| 506 | GSYSCWVENA | 10 |
| 511 | WVENAIGKTA | 10 |
| 514 | NAIGKTAVTA | 10 |
| 521 | VTANLDIRNA | 10 |
| 565 | KLSWSKDGEA | 10 |
| 581 | EDGRIIIDGA | 10 |
| 600 | EDQGIYCCSA | 10 |
| 603 | GIYCCSAHTA | 10 |
| 607 | CSAHTALDSA | 10 |
| 641 | NRSVRLTWEA | 10 |
| 684 | KKTTVILPLA | 10 |
| 695 | FVRYQFRVIA | 10 |
| 716 | PSDHHETPPA | 10 |
| 729 | RNPQNIRVQA | 10 |
| 763 | YRVTWKPQGA | 10 |
| 783 | NHTLRVMTPA | 10 |
| 786 | LRVMTPAVYA | 10 |
| 794 | YAPYDVKVQA | 10 |
| 819 | YSGEDYPDTA | 10 |
| 891 | NSGMVPSLDA | 10 |
| 901 | FSEFHLTVLA | 10 |
| 907 | TVLAYNSKGA | 10 |
| 939 | KVIKVDKDTA | 10 |
| 992 | PSWHLSNLNA | 10 |
| 1002 | TTKYKFYLRA | 10 |
| 1048 | HPIEVFEPGA | 10 |
| 1078 | VIETRGREYA | 10 |
| 1096 | QGWFIGLMCA | 10 |
| 1168 | NRDMQPTESA | 10 |
| 1191 | FSEDGSFIGA | 10 |
| 1209 | SVESNGSSTA | 10 |
| 1215 | SSTATFPLRA | 10 |
| 16 | FLLLKFSKAI | 9 |
| 38 | IKQSKVQVAF | 9 |
| 51 | EYFQIECEAK | 9 |
| 103 | FQGKYRCFAS | 9 |
| 110 | FASNKLGIAM | 9 |
| 183 | SQKGDLYFAN | 9 |
| 222 | LTVNSLKHAN | 9 |
| 235 | SSTEIGSKAN | 9 |
| 272 | EILLLECFAE | 9 |
| 320 | DKGNYRCTAS | 9 |
| 327 | TASNFLGTAT | 9 |
| 348 | RWTKKPQSAV | 9 |
| 362 | SNGILLCEAE | 9 |
| 385 | SPVDNHPFAG | 9 |
| 405 | TNLQPNHTAV | 9 |
| 411 | HTAVYQCEAS | 9 |
| 420 | SNVHGTILAN | 9 |
| 422 | VHGTILANAN | 9 |
| 442 | QTKDGENYAT | 9 |
| 449 | YATVVGYSAF | 9 |
| 457 | AFLHCEFFAS | 9 |
| 461 | CEFFASPEAV | 9 |

TABLE XXXVI-continued

| Pos | 1234567890 | score |
|---|---|---|
| 497 | INRTTEEDAG | 9 |
| 507 | SYSCWVENAI | 9 |
| 512 | VENAIGKTAV | 9 |
| 515 | AIGKTAVTAN | 9 |
| 522 | TANLDIRNAT | 9 |
| 566 | LSWSKDGEAF | 9 |
| 582 | DGRIIIDGAN | 9 |
| 601 | DQGIYCCSAH | 9 |
| 604 | IYCCSAHTAL | 9 |
| 642 | RSVRLTWEAG | 9 |
| 644 | VRLTWEAGAD | 9 |
| 685 | KTTVILPLAP | 9 |
| 696 | VRYQFRVIAV | 9 |
| 730 | NPQNIRVQAS | 9 |
| 764 | RVTWKPQGAP | 9 |
| 784 | HTLRVMTPAV | 9 |
| 787 | RVMTPAVYAP | 9 |
| 795 | APYDVKVQAI | 9 |
| 820 | SGEDYPDTAP | 9 |
| 892 | SGMVPSLDAF | 9 |
| 902 | SEFHLTVLAY | 9 |
| 908 | VLAYNSKGAG | 9 |
| 940 | VIKVDKDTAT | 9 |
| 993 | SWHLSNLNAT | 9 |
| 1003 | TKYKFYLRAC | 9 |
| 1049 | PIEVFEPGAE | 9 |
| 1079 | IETRGREYAG | 9 |
| 1097 | GWFIGLMCAI | 9 |
| 1099 | FIGLMCAIAL | 9 |
| 1169 | RDMQPTESAD | 9 |
| 1192 | SEDGSFIGAY | 9 |
| 1194 | DGSFIGAYAG | 9 |
| 1210 | VESNGSSTAT | 9 |
| | V2-(SET1)-HLA-A0203-10mers-282P1G3 | |
| | NoResultsFound. | |
| | V2-(SET2)HLA-A0203-10mers-282P1G3 Each peptide is a portion of SEQ ID NO: 5; each start position is specified, the length of peptide is 10 amino acids, and the end position for each peptide is the start position plus nine. | |
| 1 | GGDLPKGREA | 10 |
| 2 | GDLPKGREAK | 9 |
| 3 | DLPKGREAKE | 8 |
| | V2-(SET3)HLA-A0203-10mers-282P1G3 Each peptide is a portion of SEQ ID NO: 5; each start position is specified, the length of peptide is 10 amino acids, and the end position for each peptide is the start position plus nine. | |
| 3 | SSTLGEGKYA | 10 |
| 4 | STLGEGKYAG | 9 |
| 5 | TLGEGKYAGL | 8 |
| | V3-HLA-A0203-10mers- Each peptide is a portion of SEQ ID NO: 7; each start position is specified, the length of peptide is 10 amino acids, and the end position for each peptide is the start position plus nine. | |
| 14 | VSNTTYVSNA | 10 |

TABLE XXXVI-continued

| Pos | 1234567890 | score |
|---|---|---|
| 40 | LSYRNRNMLA | 10 |
| 15 | SNTTYVSNAT | 9 |
| 41 | SYRNRNMLAE | 9 |
| 16 | NTTYVSNATG | 8 |
| 42 | YRNRNMLAED | 8 |
| | V4-HLA-A0203-10mers- | |
| | NoResultsFound. | |
| | V5-HLA-A0203-10mers- | |
| | NoResultsFound. | |
| | V6-HLA-A0203-10mers- | |
| | NoResultsFound. | |
| | V7-HLA-A0203-10mers- | |
| | NoResultsFound. | |

TABLE XXXVII

| Pos | 1234567890 | score |
|---|---|---|
| | V1-A3-10mers-282P12G3 Each peptide is a portion of SEQ ID NO: 3; each start position is specified, the length of peptide is 10 amino acids, and the end position for each peptide is the start position plus nine. | |
| 11 | IVYLMFLLLK | 30 |
| 995 | HLSNLNATTK | 29 |
| 342 | IVEEPPRWTK | 28 |
| 701 | RVIAVNEVGR | 27 |
| 785 | TLRVMTPAVY | 27 |
| 1037 | KISGVNLTQK | 27 |
| 1111 | LLLLTVCFVK | 27 |
| 406 | NLQPNHTAVY | 26 |
| 1121 | RNRGGKYSVK | 26 |
| 126 | IVPSVPKLPK | 25 |
| 4 | LLLGRGLIVY | 24 |
| 33 | QVPTIIKQSK | 24 |
| 187 | DLYFANVEEK | 24 |
| 645 | RLTWEAGADH | 24 |
| 870 | SLLDGRTHPK | 24 |
| 1118 | FVKRNRGGKY | 24 |
| 105 | GKYRCFASNK | 23 |
| 413 | AVYQCEASNV | 23 |
| 478 | EVKPLEGRRY | 23 |
| 523 | ANLDIRNATK | 23 |
| 689 | ILPLAPFVRY | 23 |
| 792 | AVYAPYDVKV | 23 |
| 1077 | DVIETRGREY | 23 |
| 312 | KIENVSYQDK | 22 |
| 688 | VILPLAPFVR | 22 |
| 691 | PLAPFVRYQF | 22 |
| 905 | HLTVLAYNSK | 22 |
| 1107 | ALLTLLLLTV | 22 |
| 1196 | SFIGAYAGSK | 22 |
| 30 | SVQQVPTIIK | 21 |
| 82 | RIIPSNNSGT | 21 |
| 176 | QDERVYMSQK | 21 |
| 208 | FPRLRTIVQK | 21 |
| 238 | EIGSKANSIK | 21 |
| 585 | IIIDGANLTI | 21 |
| 680 | RVQGKKTTVI | 21 |
| 704 | AVNEVGRSQP | 21 |
| 733 | NIRVQASQPK | 21 |

TABLE XXXVII-continued

| Pos | 1234567890 | score |
|---|---|---|
| 815 | SVTLYSGEDY | 21 |
| 930 | GVPEQPTFLK | 21 |
| 295 | GDLPKGRETK | 20 |
| 381 | RVNGSPVDNH | 20 |
| 532 | KLRVSPKNPR | 20 |
| 707 | EVGRSQPSQP | 20 |
| 939 | KVIKVDKDTA | 20 |
| 1112 | LLLTVCFVKR | 20 |
| 1136 | HPDPEIQSVK | 20 |
| 1143 | SVKDETFGEY | 20 |
| 3 | PLLLGRGLIV | 19 |
| 24 | AIEIPSSVQQ | 19 |
| 83 | IIPSNNSGTF | 19 |
| 93 | RIPNEGHISH | 19 |
| 148 | PIVLPCNPPK | 19 |
| 179 | RVYMSQKGDL | 19 |
| 451 | TVVGYSAFLH | 19 |
| 488 | HIYENGTLQI | 19 |
| 584 | RIIIDGANLT | 19 |
| 603 | GIYCCSAHTA | 19 |
| 1057 | AEHIVRLMTK | 19 |
| 1088 | GLYDDISTQG | 19 |
| 36 | TIIKQSKVQV | 18 |
| 149 | IVLPCNPPKG | 18 |
| 210 | RLRTIVQKMP | 18 |
| 212 | RTIVQKMPMK | 18 |
| 252 | KLLLPPTESG | 18 |
| 253 | LLLPPTESGS | 18 |
| 268 | ILKGEILLLE | 18 |
| 273 | ILLLECFAEG | 18 |
| 292 | KIGGDLPKGR | 18 |
| 426 | ILANANIDVV | 18 |
| 475 | KVEEVKPLEG | 18 |
| 481 | PLEGRRYHIY | 18 |
| 511 | WVENAIGKTA | 18 |
| 534 | RVSPKNPRIP | 18 |
| 596 | NVTLEDQGIY | 18 |
| 643 | SVRLTWEAGA | 18 |
| 695 | FVRYQFRVIA | 18 |
| 800 | KVQAINQLGS | 18 |
| 834 | VDVINSTLVK | 18 |
| 835 | DVINSTLVKV | 18 |
| 857 | RLKGYQINWW | 18 |
| 1166 | SLNRDMQPTE | 18 |
| 1209 | SVESNGSSTA | 18 |
| 5 | LLGRGLIVYL | 17 |
| 44 | QVAFPFDEYF | 17 |
| 62 | NPEPTFSWTK | 17 |
| 123 | IEFIVPSVPK | 17 |
| 226 | SLKHANDSSS | 17 |
| 309 | KTLKIENVSY | 17 |
| 315 | NVSYQDKGNY | 17 |
| 322 | GNYRCTASNF | 17 |
| 356 | AVYSTGSNGI | 17 |
| 435 | VDVRPLIQTK | 17 |
| 436 | DVRPLIQTKD | 17 |
| 440 | LIQTKDGENY | 17 |
| 469 | AVVSWQKVEE | 17 |
| 499 | RTTEEDAGSY | 17 |
| 612 | ALDSAADITQ | 17 |
| 687 | TVILPLAPFV | 17 |
| 732 | QNIRVQASQP | 17 |
| 735 | RVQASQPKEM | 17 |
| 829 | PVIHGVDVIN | 17 |
| 840 | TLVKVTWSTV | 17 |
| 853 | RVHGRLKGYQ | 17 |
| 942 | KVDKDTATLS | 17 |
| 947 | TATLSWGLPK | 17 |
| 1010 | RACTSQGCGK | 17 |
| 1060 | IVRLMTKNWG | 17 |
| 1073 | SIFQDVIETR | 17 |
| 1159 | PLKGSLRSLN | 17 |
| 1179 | SLVEYGEGDH | 17 |
| 122 | EIEFIVPSVP | 16 |
| 142 | EVEEGDPIVL | 16 |
| 254 | LLPPTESGSE | 16 |
| 274 | LLLECFAEGL | 16 |

TABLE XXXVII-continued

| Pos | 1234567890 | score |
|---|---|---|
| 370 | AEGEPQPTIK | 16 |
| 395 | DVVFPREISF | 16 |
| 396 | VVFPREISFT | 16 |
| 466 | SPEAVVSWQK | 16 |
| 514 | NAIGKTAVTA | 16 |
| 559 | HLKHSLKLSW | 16 |
| 561 | KHSLKLSWSK | 16 |
| 633 | NLHLSERQNR | 16 |
| 677 | ELTRVQGKKT | 16 |
| 738 | ASQPKEMIIK | 16 |
| 764 | RVTWKPQGAP | 16 |
| 841 | LVKVTWSTVP | 16 |
| 850 | PKDRVHGRLK | 16 |
| 882 | NILRFSGQRN | 16 |
| 936 | TFLKVIKVDK | 16 |
| 957 | KLNGNLTGYL | 16 |
| 980 | ELNDINITTP | 16 |
| 982 | NDINITTPSK | 16 |
| 998 | NLNATTKYKF | 16 |
| 1101 | GLMCAIALLT | 16 |
| 1105 | AIALLTLLLL | 16 |
| 1108 | LLTLLLLTVC | 16 |
| 1128 | SVKEKEDLHP | 16 |
| 1134 | DLHPDPEIQS | 16 |
| 1140 | EIQSVKDETF | 16 |
| 1163 | SLRSLNRDMQ | 16 |
| 1189 | GLFSEDGSFI | 16 |
| 1197 | FIGAYAGSKE | 16 |
| 17 | LLLKFSKAIE | 15 |
| 37 | IIKQSKVQVA | 15 |
| 99 | HISHFQGKYR | 15 |
| 219 | PMKLTVNSLK | 15 |
| 243 | ANSIKQRKPK | 15 |
| 290 | WNKIGGDLPK | 15 |
| 310 | TLKIENVSYQ | 15 |
| 365 | ILLCEAEGEP | 15 |
| 421 | NVHGTILANA | 15 |
| 433 | DVVDVRPLIQ | 15 |
| 458 | FLHCEFFASP | 15 |
| 520 | AVTANLDIRN | 15 |
| 524 | NLDIRNATKL | 15 |
| 526 | DIRNATKLRV | 15 |
| 541 | RIPKLHMLEL | 15 |
| 546 | HMLELHCESK | 15 |
| 626 | DVPDPPENLH | 15 |
| 636 | LSERQNRSVR | 15 |
| 639 | RQNRSVRLTW | 15 |
| 710 | RSQPSQPSDH | 15 |
| 744 | MIIKWEPLKS | 15 |
| 759 | PGLEYRVTWK | 15 |
| 773 | PVEWEEETVT | 15 |
| 780 | TVTNHTLRVM | 15 |
| 787 | RVMTPAVYAP | 15 |
| 806 | QLGSGPDPQS | 15 |
| 860 | GYQINWWKTK | 15 |
| 883 | ILRFSGQRNS | 15 |
| 894 | MVPSLDAFSE | 15 |
| 948 | ATLSWGLPKK | 15 |
| 1008 | YLRACTSQGC | 15 |
| 1028 | LGEGSKGIGK | 15 |
| 1034 | GIGKISGVNL | 15 |
| 1062 | RLMTKNWGDN | 15 |
| 16 | FLLLKFSKAI | 14 |
| 18 | LLKFSKAIEI | 14 |
| 23 | KAIEIPSSVQ | 14 |
| 42 | KVQVAFPFDE | 14 |
| 114 | KLGIAMSEEI | 14 |
| 128 | PSVPKLPKEK | 14 |
| 137 | KIDPLEVEEG | 14 |
| 158 | GLPPLHIYWM | 14 |
| 170 | ELEHIEQDER | 14 |
| 172 | EHIEQDERVY | 14 |
| 233 | SSSSTEIGSK | 14 |
| 328 | ASNFLGTATH | 14 |
| 331 | FLGTATHDFH | 14 |
| 340 | HVIVEEPPRW | 14 |
| 343 | VEEPPRWTKK | 14 |

TABLE XXXVII-continued

| Pos | 1234567890 | score |
|---|---|---|
| 349 | WTKKPQSAVY | 14 |
| 364 | GILLCEAEGE | 14 |
| 366 | LLCEAEGEPQ | 14 |
| 386 | PVDNHPFAGD | 14 |
| 439 | PLIQTKDGEN | 14 |
| 471 | VSWQKVEEVK | 14 |
| 509 | SCWVENAIGK | 14 |
| 547 | MLELHCESKC | 14 |
| 565 | KLSWSKDGEA | 14 |
| 660 | EYIVEFEGNK | 14 |
| 671 | EPGRWEELTR | 14 |
| 743 | EMIIKWEPLK | 14 |
| 791 | PAVYAPYDVK | 14 |
| 798 | DVKVQAINQL | 14 |
| 817 | TLYSGEDYPD | 14 |
| 822 | EDYPDTAPVI | 14 |
| 842 | VKVTWSTVPK | 14 |
| 848 | TVPKDRVHGR | 14 |
| 880 | EVNILRFSGQ | 14 |
| 907 | TVLAYNSKGA | 14 |
| 933 | EQPTFLKVIK | 14 |
| 960 | GNLTGYLLQY | 14 |
| 967 | LQYQIINDTY | 14 |
| 970 | QIINDTYEIG | 14 |
| 986 | ITTPSKPSWH | 14 |
| 997 | SNLNATTKYK | 14 |
| 1051 | EVFEPGAEHI | 14 |
| 1082 | RGREYAGLYD | 14 |
| 1123 | RGGKYSVKEK | 14 |
| 1156 | DEKPLKGSLR | 14 |

V2-(SET1)-HLA-A3-10mers-282P1G3 Each peptide is a portion of SEQ ID NO: 5; each start position is specified, the length of peptide is 10 amino acids, and the end position for each peptide is the start position plus nine.

| Pos | 1234567890 | score |
|---|---|---|
| 3 | IVPSVPKFPK | 22 |
| 5 | PSVPKFPKEK | 14 |
| 2 | FIVPSVPKFP | 12 |
| 6 | SVPKFPKEKI | 11 |

V2-(SET2)-HLA-A3-10mers-282P1G3 Each peptide is a portion of SEQ ID NO: 5; each start position is specified, the length of peptide is 10 amino acids, and the end position for each peptide is the start position plus nine.

| Pos | 1234567890 | score |
|---|---|---|
| 2 | GDLPKGREAK | 17 |
| 10 | AKENYGKTLK | 15 |
| 3 | DLPKGREAKE | 13 |
| 7 | GREAKENYGK | 12 |

V2-(SET3)-HLA-A3-10mers-282P1G3 Each peptide is a portion of SEQ ID NO: 5; each start position is specified, the length of peptide is 10 amino acids, and the end position for each peptide is the start position plus nine.

| Pos | 1234567890 | score |
|---|---|---|
| 5 | TLGEGKYAGL | 14 |
| 1 | EESSTLGEGK | 13 |
| 6 | LGEGKYAGLY | 12 |
| 2 | ESSTLGEGKY | 7 |
| 4 | STLGEGKYAG | 6 |
| 7 | GEGKYAGLYD | 6 |
| 9 | GKYAGLYDDI | 6 |
| 10 | KYAGLYDDIS | 6 |

TABLE XXXVII-continued

| Pos | 1234567890 | score |
|---|---|---|
| | V3-HLA-A3-10mers-282P1G3 Each peptide is a portion of SEQ ID NO: 7; each start position is specified, the length of peptide is 10 amino acids, and the end position for each peptide is the start position plus nine. | |
| 7 | DVINTTYVSN | 20 |
| 61 | YVEKSSTFFK | 20 |
| 1 | PVIHGVDVIN | 17 |
| 13 | YVSNTTYVSN | 17 |
| 19 | YVSNATGSPQ | 17 |
| 46 | NMLAEDFIQK | 17 |
| 55 | KSTSCNYVEK | 17 |
| 43 | RNRNMLAEDF | 15 |
| 59 | CNYVEKSSTF | 15 |
| 52 | FIQKSTSCNY | 14 |
| 30 | SIFICSKEQE | 13 |
| 33 | ICSKEQELSY | 13 |
| 4 | HGVDVINTTY | 12 |
| 27 | PQPSIFICSK | 12 |
| 39 | ELSYRNRNML | 12 |
| 47 | MLAEDFIQKS | 12 |
| 5 | GVDVINTTYV | 11 |
| 8 | VINTTYVSNT | 11 |
| 10 | NTTYVSNTTY | 11 |
| 23 | ATGSPQPSIF | 11 |
| 2 | VIHGVDVINT | 10 |
| 49 | AEDFIQKSTS | 10 |
| 34 | CSKEQELSYR | 9 |
| 41 | SYRNRNMLAE | 9 |
| | V4-HLA-A3-10mers-282P1G3 Each peptide is a portion of SEQ ID NO: 9; each start position is specified, the length of peptide is 10 amino acids, and the end position for each peptide is the start position plus nine. | |
| 9 | DLPEQPTFLK | 21 |
| 3 | TLYSGEDLPE | 17 |
| 1 | SVTLYSGEDL | 15 |
| | V5-HLA-A3-10mers-282P1G3 Each peptide is a portion of SEQ ID NO: 11; each start position is specified, the length of peptide is 10 amino acids, and the end position for each peptide is the start position plus nine. | |
| 4 | KLTVNSSNSI | 15 |
| 5 | LTVNSSNSIK | 14 |
| 10 | SNSIKQRKPK | 13 |
| 8 | NSSNSIKQRK | 11 |
| 6 | TVNSSNSIKQ | 10 |
| 2 | PMKLTVNSSN | 7 |
| 7 | VNSSNSIKQR | 7 |
| | V6-HLA-A3-10mers-282P1G3 Each peptide is a portion of SEQ ID NO: 13; each start position is specified, the length of peptide is 10 amino acids, and the end position for each peptide is the start position plus nine. | |
| 10 | KLEHIEQDER | 17 |
| 1 | SEEIEFIVPK | 16 |
| 7 | IVPKLEHIEQ | 12 |
| 6 | FIVPKLEHIE | 11 |
| 4 | IEFIVPKLEH | 10 |
| 3 | EIEFIVPKLE | 9 |
| | V7-HLA-A3-10mers-282P1G3 Each peptide is a portion of SEQ ID NO: 15; each start position is specified, the length of peptide is 10 amino acids, and the end position for each peptide is the start position plus nine. | |
| 5 | HVIVEDNISH | 19 |
| 19 | LHPEPPRWTK | 16 |
| 18 | TLHPEPPRWT | 15 |
| 20 | HPEPPRWTKK | 14 |
| 7 | IVEDNISHEL | 13 |
| 11 | NISHELFTLH | 13 |
| 6 | VIVEDNISHE | 12 |
| 15 | ELFTLHPEPP | 11 |

TABLE XXXVII

| Pos | 1234567890 | score |
|---|---|---|
| | V1-HLA-A26-10mers-282P1G3 Each peptide is a portion of SEQ ID NO: 3; each start position is specified, the length of peptide is 10 amino acids, and the end position for each peptide is the start position plus nine. | |
| 1077 | DVIETRGREY | 35 |
| 395 | DVVFPREISF | 32 |
| 478 | EVKPLEGRRY | 32 |
| 142 | EVEEGDPIVL | 31 |
| 798 | DVKVQAINQL | 31 |
| 302 | ETKENYGKTL | 30 |
| 124 | EFIVPSVPKL | 27 |
| 835 | DVINSTLVKV | 27 |
| 172 | EHIEQDERVY | 26 |
| 852 | DRVHGRLKGY | 26 |
| 1051 | EVFEPGAEHI | 26 |
| 1080 | ETRGREYAGL | 26 |
| 686 | TTVILPLAPF | 25 |
| 433 | DVVDVRPLIQ | 24 |
| 1140 | EIQSVKDETF | 24 |
| 499 | RTTEEDAGSY | 23 |
| 779 | ETVTNHTLRV | 23 |
| 815 | SVTLYSGEDY | 23 |
| 929 | EGVPEQPTFL | 23 |
| 1118 | FVKRNRGGKY | 23 |
| 1143 | SVKDETFGEY | 23 |
| 1147 | ETFGEYSDSD | 23 |
| 596 | NVTLEDQGIY | 22 |
| 707 | EVGRSQPSQP | 22 |
| 1054 | EPGAEHIVRL | 22 |
| 121 | EEIEFIVPSV | 21 |
| 266 | ITILKGEILL | 21 |
| 315 | NVSYQDKGNY | 21 |
| 875 | RTHPKEVNIL | 21 |
| 880 | EVNILRFSGQ | 21 |
| 902 | SEFHLTVLAY | 21 |
| 1182 | EYGEGDHGLF | 21 |
| 396 | VVFPREISFT | 20 |
| 436 | DVRPLIQTKD | 20 |
| 450 | ATVVGYSAFL | 20 |
| 58 | EAKGNPEPTF | 19 |

TABLE XXXVII-continued

| Pos | 1234567890 | score |
|---|---|---|
| 179 | RVYMSQKGDL | 19 |
| 277 | ECFAEGLPTP | 19 |
| 309 | KTLKIENVSY | 19 |
| 418 | EASNVHGTIL | 19 |
| 626 | DVPDPPENLH | 19 |
| 721 | ETPPAAPDRN | 19 |
| 777 | EEETVTNHTL | 19 |
| 974 | DTYEIGELND | 19 |
| 1151 | EYSDSDEKPL | 19 |
| 1211 | ESNGSSTATF | 19 |
| 44 | QVAFPFDEYF | 18 |
| 213 | TIVQKMPMKL | 18 |
| 267 | TILKGEILLL | 18 |
| 349 | WTKKPQSAVY | 18 |
| 401 | EISFTNLQPN | 18 |
| 557 | DSHLKHSLKL | 18 |
| 618 | DITQVTVLDV | 18 |
| 656 | SNISEYIVEF | 18 |
| 826 | DTAPVIHGVD | 18 |
| 987 | TTPSKPSWHL | 18 |
| 10 | LIVYLMFLLL | 17 |
| 69 | WTKDGNPFYF | 17 |
| 98 | GHISHFQGKY | 17 |
| 573 | EAFEINGTED | 17 |
| 946 | DTATLSWGLP | 17 |
| 977 | EIGELNDINI | 17 |
| 1072 | DSIFQDVIET | 17 |
| 1105 | AIALLTLLLL | 17 |
| 1192 | SEDGSFIGAY | 17 |
| | V2-(SET1)-HLA-A26-10mers-282P1G3 Each peptide is a portion of SEQ ID NO: 5; each start position is specified, the length of peptide is 10 amino acids, and the end position for each peptide is the start position plus nine. | |
| 1 | EFIVPSVPKF | 27 |
| | V2-(SET2)-HLA-A26-10mers-282P1G3 Each peptide is a portion of SEQ ID NO: 5; each start position is specified, the length of peptide is 10 amino acids, and the end position for each peptide is the start position plus nine. | |
| 9 | EAKENYGKTL | 22 |
| 5 | PKGREAKENY | 10 |
| | V2-(SET3)-HLA-A26-10mers-282P1G3 Each peptide is a portion of SEQ ID NO: 5; each start position is specified, the length of peptide is 10 amino acids, and the end position for each peptide is the start position plus nine. | |
| 2 | ESSTLGEGKY | 22 |
| 8 | EGKYAGLYDD | 14 |
| 1 | EESSTLGEGK | 12 |
| 5 | TLGEGKYAGL | 11 |
| 6 | LGEGKYAGLY | 11 |
| 4 | STLGEGKYAG | 10 |
| | V3-HLA-A26-10mers-282P1G3 Each peptide is a portion of SEQ ID NO: 7; each start position is specified, the length of peptide is 10 amino acids, and the end position for each peptide is the start position plus nine. | |
| 2 | EEIEFIVPKL | 29 |
| 5 | EFIVPKLEHI | 18 |
| 3 | EIEFIVPKLE | 14 |
| | V4-HLA-A26-10mers-282P1G3 Each peptide is a portion of SEQ ID NO: 9; each start position is specified, the length of peptide is 10 amino acids, and the end position for each peptide is the start position plus nine. | |
| 1 | SVTLYSGEDL | 21 |
| 8 | EDLPEQPTFL | 19 |
| 9 | DLPEQPTFLK | 10 |
| | V5-HLA-A26-10mers-282P1G3 Each peptide is a portion of SEQ ID NO: 11; each start position is specified, the length of peptide is 10 amino acids, and the end position for each peptide is the start position plus nine. | |
| 6 | TVNSSNSIKQ | 14 |
| 5 | LTVNSSNSIK | 13 |
| 7 | VNSSNSIKQR | 6 |
| | V6-HLA-A26-10mers-282P1G3 Each peptide is a portion of SEQ ID NO: 13; each start position is specified, the length of peptide is 10 amino acids, and the end position for each peptide is the start position plus nine. | |
| 2 | EEIEFIVPKL | 29 |
| 5 | EFIVPKLEHI | 18 |
| 3 | EIEFIVPKLE | 14 |
| | V7-HLA-A26-10mers-282P1G3 Each peptide is a portion of SEQ ID NO: 15; each start position is specified, the length of peptide is 10 amino acids, and the end position for each peptide is the start position plus nine. | |
| 10 | DNISHELFTL | 26 |
| 7 | IVEDNISHEL | 19 |
| 5 | HVIVEDNISH | 16 |
| 6 | VIVEDNISHE | 15 |
| 15 | ELFTLHPEPP | 14 |

TABLE XXXIX

| Pos | 1234567890 | score |
|---|---|---|
| V1-HLA-B0702-10mers-282P1G3 Each peptide is a portion of SEQ ID NO: 3; each start position is specified, the length of peptide is 10 amino acids, and the end position for each peptide is the start position plus nine. | | |
| 1054 | EPGAEHIVRL | 25 |
| 398 | FPREISFTNL | 24 |
| 627 | VPDPPENLHL | 24 |
| 218 | MPMKLTVNSL | 23 |
| 27 | IPSSVQQVPT | 22 |
| 539 | NPRIPKLHML | 22 |
| 1158 | KPLKGSLRSL | 22 |
| 536 | SPKNPRIPKL | 21 |
| 1019 | KPITEESSTL | 21 |
| 155 | PPKGLPPLHI | 20 |
| 795 | APYDVKVQAI | 20 |
| 828 | APVIHGVDVI | 20 |
| 849 | VPKDRVHGRL | 20 |
| 895 | VPSLDAFSEF | 19 |
| 927 | TPEGVPEQPT | 19 |
| 931 | VPEQPTFLKV | 19 |
| 2 | EPLLLGRGLI | 18 |
| 373 | EPQPTIKWRV | 18 |
| 480 | KPLEGRRYHI | 18 |
| 693 | APFVRYQFRV | 18 |
| 772 | APVEWEEETV | 18 |
| 877 | HPKEVNILRF | 18 |
| 94 | IPNEGHISHF | 17 |
| 790 | TPAVYAPYDV | 17 |
| 934 | QPTFLKVIKV | 17 |
| 954 | LPKKLNGNLT | 17 |
| 1048 | HPIEVFEPGA | 17 |
| 34 | VPTIIKQSKV | 16 |
| 74 | NPFYFTDHRI | 16 |
| 160 | PPLHIYWMNI | 16 |
| 616 | AADITQVTVL | 16 |
| 900 | AFSEFHLTVL | 16 |
| 1080 | ETRGREYAGL | 16 |
| 1172 | QPTESADSLV | 16 |
| 84 | IPSNNSGTFR | 15 |
| 390 | HPFAGDVVFP | 15 |
| 681 | VQGKKTTVIL | 15 |
| 1105 | AIALLTLLLL | 15 |
| 208 | FPRLRTIVQK | 14 |
| 418 | EASNVHGTIL | 14 |
| 450 | ATVVGYSAFL | 14 |
| 541 | RIPKLHMLEL | 14 |
| 590 | ANLTISNVTL | 14 |
| 637 | SERQNRSVRL | 14 |
| 671 | EPGRWEELTR | 14 |
| 715 | QPSDHHETPP | 14 |
| 723 | PPAAPDRNPQ | 14 |
| 758 | GPGLEYRVTW | 14 |
| 768 | KPQGAPVEWE | 14 |
| 810 | GPDPQSVTLY | 14 |
| 929 | EGVPEQPTFL | 14 |
| 957 | KLNGNLTGYL | 14 |
| 1034 | GIGKISGVNL | 14 |
| 1104 | CAIALLTLLL | 14 |
| 1151 | EYSDSDEKPL | 14 |
| 1213 | NGSSTATFPL | 14 |
| 5 | LLGRGLIVYL | 13 |
| 10 | LIVYLMFLLL | 13 |
| 106 | KYRCFASNKL | 13 |
| 124 | EFIVPSVPKL | 13 |
| 127 | VPSVPKLPKE | 13 |
| 132 | KLPKEKIDPL | 13 |
| 153 | CNPPKGLPPL | 13 |
| 246 | IKQRKPKLLL | 13 |
| 260 | SGSESSITIL | 13 |
| 267 | TILKGEILLL | 13 |
| 297 | LPKGRETKEN | 13 |
| 323 | NYRCTASNFL | 13 |
| 346 | PPRWTKKPQS | 13 |
| 375 | QPTIKWRVNG | 13 |
| 431 | NIDVVDVRPL | 13 |

TABLE XXXIX-continued

| Pos | 1234567890 | score |
|---|---|---|
| 516 | IGKTAVTANL | 13 |
| 604 | IYCCSAHTAL | 13 |
| 683 | GKKTTVILPL | 13 |
| 726 | APDRNPQNIR | 13 |
| 742 | KEMIIKWEPL | 13 |
| 752 | KSMEQNGPGL | 13 |
| 875 | RTHPKEVNIL | 13 |
| 921 | EPYIFQTPEG | 13 |
| 941 | IKVDKDTATL | 13 |
| 988 | TPSKPSWHLS | 13 |
| 991 | KPSWHLSNLN | 13 |
| 1102 | LMCAIALLTL | 13 |
| 1126 | KYSVKEKEDL | 13 |
| 1136 | HPDPEIQSVK | 13 |
| 8 | RGLIVYLMFL | 12 |
| 64 | EPTFSWTKDG | 12 |
| 142 | EVEEGDPIVL | 12 |
| 154 | NPPKGLPPLH | 12 |
| 202 | YCCFAAFPRL | 12 |
| 244 | NSIKQRKPKL | 12 |
| 250 | KPKLLLPPTE | 12 |
| 345 | EPPRWTKKPQ | 12 |
| 357 | VYSTGSNGIL | 12 |
| 358 | YSTGSNGILL | 12 |
| 428 | ANANIDVVDV | 12 |
| 473 | WQKVEEVKPL | 12 |
| 524 | NLDIRNATKL | 12 |
| 555 | KCDSHLKHSL | 12 |
| 557 | DSHLKHSLKL | 12 |
| 629 | DPPENLHLSE | 12 |
| 669 | KEEPGRWEEL | 12 |
| 680 | RVQGKKTTVI | 12 |
| 690 | LPLAPFVRYQ | 12 |
| 712 | QPSQPSDHHE | 12 |
| 730 | NPQNIRVQAS | 12 |
| 749 | EPLKSMEQNG | 12 |
| 809 | SGPDPQSVTL | 12 |
| 824 | YPDTAPVIHG | 12 |
| 889 | QRNSGMVPSL | 12 |
| 897 | SLDAFSEFHL | 12 |
| 945 | KDTATLSWGL | 12 |
| 949 | TLSWGLPKKL | 12 |
| 972 | INDTYEIGEL | 12 |
| 1093 | ISTQGWFIGL | 12 |
| 1099 | FIGLMCAIAL | 12 |
| 1100 | IGLMCAIALL | 12 |
| 1103 | MCAIALLTLL | 12 |
| 1181 | VEYGEGDHGL | 12 |
| V2-(SET1)-HLA-B0702-10mers-282P1G3 Each peptide is a portion of SEQ ID NO: 5; each start position is specified, the length of peptide is 10 amino acids, and the end position for each peptide is the start position plus nine. | | |
| 9 | KFPKEKIDPL | 13 |
| 10 | FPKEKIDPLE | 11 |
| 7 | VPKFPKEKID | 10 |
| 1 | EFIVPSVPKF | 9 |
| 6 | SVPKFPKEKI | 7 |
| V2-(SET2)-HLA-B0702-10mers-282P1G3 Each peptide is a portion of SEQ ID NO: 5; each start position is specified, the length of peptide is 10 amino acids, and the end position for each | | |

TABLE XXXIX-continued

| Pos | 1234567890 | score |
|---|---|---|
| | peptide is the start position plus nine. | |
| 4 | LPKGREAKEN | 12 |
| 9 | EAKENYGKTL | 11 |
| 8 | REAKENYGKT | 9 |
| 1 | GGDLPKGREA | 7 |
| | V2-(SET3)-HLA-B0702-10mers-282P1G3 Each peptide is a portion of SEQ ID NO: 5; each start position is specified, the length of peptide is 10 amino acids, and the end position for each peptide is the start position plus nine. | |
| 5 | TLGEGKYAGL | 12 |
| 9 | GKYAGLYDDI | 7 |
| 3 | SSTLGEGKYA | 6 |
| | V3-HLA-B0702-10mers-282P1G3 Each peptide is a portion of SEQ ID NO: 7; each start position is specified, the length of peptide is 10 amino acids, and the end position for each peptide is the start position plus nine. | |
| 7 | DVINTTYVSN | 23 |
| 10 | NTTYVSNTTY | 20 |
| 39 | ELSYRNRNML | 19 |
| 23 | ATGSPQPSIF | 18 |
| 4 | HGVDVINTTY | 16 |
| 50 | EDFIQKSTSC | 15 |
| 1 | PVIHGVDVIN | 14 |
| 52 | FIQKSTSCNY | 14 |
| 56 | STSCNYVEKS | 14 |
| 60 | NYVEKSSTFF | 14 |
| 51 | DFIQKSTSCN | 13 |
| 19 | YVSNATGSPQ | 12 |
| 31 | IFICSKEQEL | 12 |
| 33 | ICSKEQELSY | 12 |
| 13 | YVSNTTYVSN | 11 |
| | V4-HLA-B0702-10mers-282P1G3 Each peptide is a portion of SEQ ID NO: 9; each start position is specified, the length of peptide is 10 amino acids, and the end position for each peptide is the start position plus nine. | |
| 10 | LPEQPTFLKV | 19 |
| 8 | EDLPEQPTFL | 14 |
| 1 | SVTLYSGEDL | 10 |
| | V5-HLA-B0702-10mers-282P1G3 Each peptide is a portion of SEQ ID NO: 11; each start position is specified, the length of peptide is 10 amino acids, and the end position for each peptide is the start position plus nine. | |
| 1 | MPMKLTVNSS | 13 |
| 4 | KLTVNSSNSI | 7 |
| | V6-HLA- | |

TABLE XXXIX-continued

| Pos | 1234567890 | score |
|---|---|---|
| | B0702-10mers-282P1G3 Each peptide is a portion of SEQ ID NO: 13; each start position is specified, the length of peptide is 10 amino acids, and the end position for each peptide is the start position plus nine. | |
| 2 | EEIEFIVPKL | 13 |
| 8 | VPKLEHIEQD | 10 |
| 5 | EFIVPKLEHI | 7 |
| | V7-HLA-B0702-10mers-282P1G3 Each peptide is a portion of SEQ ID NO: 15; each start position is specified, the length of peptide is 10 amino acids, and the end position for each peptide is the start position plus nine. | |
| 20 | HPEPPRWTKK | 12 |
| 7 | IVEDNISHEL | 11 |
| 9 | EDNISHELFT | 10 |
| 10 | DNISHELFTL | 10 |
| 8 | VEDNISHELF | 7 |
| 18 | TLHPEPPRWT | 7 |
| 3 | DFHVIVEDNI | 6 |

TABLE XL

| Pos | 1234567890 | score |
|---|---|---|
| | V1-HLA-B08-10mers-282P1G3 | |
| | NoResultsFound. | |
| | V2-(SET1)-HLA-B08-10mers-282P1G3 | |
| | NoResultsFound. | |
| | V2-(SET2)-HLA-B08-10mers-282P1G3 | |
| | NoResultsFound. | |
| | V2-(SET3)-HLA-B08-10mers-282P1G3 | |
| | NoResultsFound. | |
| | V3-HLA-B08-10mers-282P1G3 | |
| | NoResultsFound. | |
| | V4-HLA-B08-10mers-282P1G3 | |
| | NoResultsFound. | |
| | V5-HLA-B08-10mers-282P1G3 | |
| | NoResultsFound. | |
| | V6-HLA-B08-10mers-282P1G3 | |
| | NoResultsFound. | |
| | V7-HLA-B08-10mers-282P1G3 | |
| | NoResultsFound. | |

TABLE XLI

| Pos | 1234567890 | score |
|---|---|---|
| | V1-HLA-B1510-10mers-282P1G3 | |
| | NoResultsFound. | |
| | V2-(SET1)-HLA-B1510-10mers-282P1G3 | |
| | NoResultsFound. | |
| | V2-(SET2)-HLA-B1510-10mers-282P1G3 | |
| | NoResultsFound. | |
| | V2-(SET3)-HLA-B1510-10mers-282P1G3 | |
| | NoResultsFound. | |
| | V3-HLA-B1510-10mers-(SET3)-282P1G3 | |
| | NoResultsFound. | |
| | V4-HLA-B1510-10mers-282P1G3 | |
| | NoResultsFound. | |
| | V5-HLA-B1510-10mers-282P1G3 | |
| | NoResultsFound. | |
| | V6-HLA-B1510-10mers-282P1G3 | |
| | NoResultsFound. | |
| | V7-HLA-B1510-10mers-282P1G3 | |
| | NoResultsFound. | |

TABLE XLII

| Pos | 1234567890 | score |
|---|---|---|
| | V1-HLA-B2705-10mers-282P1G3 | |
| | NoResultsFound. | |
| | V2-(SET1)-HLA-B2705-10mers-282P1G3 | |
| | NoResultsFound. | |
| | V2-(SET2)-HLA-B2705-10mers-282P1G3 | |
| | NoResultsFound. | |
| | V2-(SET3)-HLA-B2705-10mers-282P1G3 | |
| | NoResultsFound. | |
| | V3-HLA-B2705-10mers-282P1G3 | |
| | NoResultsFound. | |
| | V4-HLA-B2705-10mers-282P1G3 | |
| | NoResultsFound. | |
| | V5-HLA-B2705-10mers-282P1G3 | |
| | NoResultsFound. | |
| | V6-HLA-B2705-10mers-282P1G3 | |
| | NoResultsFound. | |
| | V7-HLA-B2705-10mers-282P1G3 | |
| | NoResultsFound. | |

TABLE XLIII

| Pos | 1234567890 | score |
|---|---|---|
| | V1-HLA-B2709-10mers-282P1G3 | |
| | NoResultsFound. | |
| | V2-(SET1)-HLA-B2709-10mers-282P1G3 | |
| | NoResultsFound. | |
| | V2-(SET2)-HLA-B2709-10mers-282P1G3 | |
| | NoResultsFound. | |
| | V2-(SET3)-HLA-B2709-10mers-282P1G3 | |
| | NoResultsFound. | |
| | V3-HLA-B2709-10mers-282P1G3 | |
| | NoResultsFound. | |
| | V4-HLA-B2709-10mers-282P1G3 | |
| | NoResultsFound. | |
| | V5-HLA-B2709-10mers-282P1G3 | |
| | NoResultsFound. | |
| | V6-HLA-B2709-10mers-282P1G3 | |
| | NoResultsFound. | |
| | V7-HLA-B2709-10mers-282P1G3 | |
| | NoResultsFound. | |

TABLE XLIV

| Pos | 1234567890 | score |
|---|---|---|
| | V1-HLA-B4402-10mers-282P1G3 Each peptide is a portion of SEQ ID NO: 3; each start position is specified, the length of peptide is 10 amino acids, and the end position for each peptide is the start position plus nine. | |
| 1192 | SEDGSFIGAY | 28 |
| 902 | SEFHLTVLAY | 27 |
| 777 | EEETVTNHTL | 25 |
| 932 | PEQPTFLKVI | 25 |
| 237 | TEIGSKANSI | 24 |
| 669 | KEEPGRWEEL | 24 |
| 1 | MEPLLLGRGL | 23 |
| 502 | EEDAGSYSCW | 23 |
| 1174 | TESADSLVEY | 23 |
| 193 | VEEKDSRNDY | 22 |
| 304 | KENYGKTLKI | 22 |
| 446 | GENYATVVGY | 22 |
| 637 | SERQNRSVRL | 22 |
| 742 | KEMIIKWEPL | 22 |
| 754 | MEQNGPGLEY | 22 |
| 1029 | GEGSKGIGKI | 22 |
| 1181 | VEYGEGDHGL | 22 |
| 928 | PEGVPEQPTF | 21 |
| 1132 | KEDLHPDPEI | 21 |
| 344 | EEPPRWTKKP | 20 |
| 417 | CEASNVHGTI | 19 |
| 25 | IEIPSSVQQV | 18 |
| 371 | EGEPQPTIKW | 18 |
| 656 | SNISEYIVEF | 18 |
| 1084 | REYAGLYDDI | 18 |
| 124 | EFIVPSVPKL | 17 |
| 172 | EHIEQDERVY | 17 |
| 262 | SESSITILKG | 17 |
| 281 | EGLPTPQVDW | 17 |
| 590 | ANLTISNVTL | 17 |
| 652 | ADHNSNISEY | 17 |
| 739 | SQPKEMIIKW | 17 |
| 1105 | AIALLTLLLL | 17 |
| 121 | EEIEFIVPSV | 16 |
| 143 | VEEGDPIVLP | 16 |
| 157 | KGLPPLHIYW | 16 |
| 266 | ITILKGEILL | 16 |
| 267 | TILKGEILLL | 16 |
| 280 | AEGLPTPQVD | 16 |
| 372 | GEPQPTIKWR | 16 |
| 383 | NGSPVDNHPF | 16 |
| 406 | NLQPNHTAVY | 16 |
| 464 | FASPEAVVSW | 16 |
| 478 | EVKPLEGRRY | 16 |
| 536 | SPKNPRIPKL | 16 |
| 580 | TEDGRIIIDG | 16 |
| 616 | AADITQVTVL | 16 |
| 810 | GPDPQSVTLY | 16 |
| 900 | AFSEFHLTVL | 16 |
| 929 | EGVPEQPTFL | 16 |
| 1019 | KPITEESSTL | 16 |
| 1054 | EPGAEHIVRL | 16 |
| 1104 | CAIALLTLLL | 16 |
| 1151 | EYSDSDEKPL | 16 |
| 4 | LLLGRGLIVY | 15 |
| 5 | LLGRGLIVYL | 15 |
| 60 | KGNPEPTFSW | 15 |
| 120 | SEEIEFIVPS | 15 |
| 132 | KLPKEKIDPL | 15 |
| 142 | EVEEGDPIVL | 15 |
| 144 | EEGDPIVLPC | 15 |
| 153 | CNPPKGLPPL | 15 |
| 244 | NSIKQRKPKL | 15 |
| 245 | SIKQRKPKLL | 15 |
| 260 | SGSESSITIL | 15 |
| 302 | ETKENYGKTL | 15 |
| 330 | NFLGTATHDF | 15 |

TABLE XLIV-continued

| Pos | 1234567890 | score |
|---|---|---|
| 400 | REISFTNLQP | 15 |
| 461 | CEFFASPEAV | 15 |
| 627 | VPDPPENLHL | 15 |
| 670 | EEPGRWEELT | 15 |
| 676 | EELTRVQGKK | 15 |
| 683 | GKKTTVILPL | 15 |
| 691 | PLAPFVRYQF | 15 |
| 795 | APYDVKVQAI | 15 |
| 798 | DVKVQAINQL | 15 |
| 809 | SGPDPQSVTL | 15 |
| 822 | EDYPDTAPVI | 15 |
| 857 | RLKGYQINWW | 15 |
| 875 | RTHPKEVNIL | 15 |
| 892 | SGMVPSLDAF | 15 |
| 916 | AGPESEPYIF | 15 |
| 918 | PESEPYIFQT | 15 |
| 949 | TLSWGLPKKL | 15 |
| 960 | GNLTGYLLQY | 15 |
| 972 | INDTYEIGEL | 15 |
| 1044 | TQKTHPIEVF | 15 |
| 1057 | AEHIVRLMTK | 15 |
| 1099 | FIGLMCAIAL | 15 |
| 1100 | IGLMCAIALL | 15 |
| 1211 | ESNGSSTATF | 15 |
| 2 | EPLLLGRGLI | 14 |
| 9 | GLIVYLMFLL | 14 |
| 12 | VYLMFLLLKF | 14 |
| 16 | FLLLKFSKAI | 14 |
| 58 | EAKGNPEPTF | 14 |
| 98 | GHISHFQGKY | 14 |
| 101 | SHFQGKYRCF | 14 |
| 150 | VLPCNPPKGL | 14 |
| 162 | LHIYWMNIEL | 14 |
| 199 | RNDYCCFAAF | 14 |
| 271 | GEILLLECFA | 14 |
| 340 | HVIVEEPPRW | 14 |
| 343 | VEEPPRWTKK | 14 |
| 370 | AEGEPQPTIK | 14 |
| 389 | NHPFAGDVVF | 14 |
| 393 | AGDVVFPREI | 14 |
| 418 | EASNVHGTIL | 14 |
| 431 | NIDVVDVRPL | 14 |
| 524 | NLDIRNATKL | 14 |
| 575 | FEINGTEDGR | 14 |
| 585 | IIIDGANLTI | 14 |
| 625 | LDVPDPPENL | 14 |
| 639 | RQNRSVRLTW | 14 |
| 689 | ILPLAPFVRY | 14 |
| 720 | HETPPAAPDR | 14 |
| 725 | AAPDRNPQNI | 14 |
| 758 | GPGLEYRVTW | 14 |
| 837 | INSTLVKVTW | 14 |
| 877 | HPKEVNILRF | 14 |
| 956 | KKLNGNLTGY | 14 |
| 976 | YEIGELNDIN | 14 |
| 979 | GELNDINITT | 14 |
| 1053 | FEPGAEHIVR | 14 |
| 1059 | HIVRLMTKNW | 14 |
| 1077 | DVIETRGREY | 14 |
| 1109 | LTLLLLTVCF | 14 |
| 1156 | DEKPLKGSLR | 14 |
| 1158 | KPLKGSLRSL | 14 |
| 1210 | VESNGSSTAT | 14 |
| 10 | LIVYLMFLLL | 13 |
| 38 | IKQSKVQVAF | 13 |
| 46 | AFPFDEYFQI | 13 |
| 63 | PEPTFSWTKD | 13 |
| 94 | IPNEGHISHF | 13 |
| 106 | KYRCFASNKL | 13 |
| 123 | IEFIVPSVPK | 13 |
| 135 | KEKIDPLEVE | 13 |
| 156 | PKGLPPLHIY | 13 |
| 194 | EEKDSRNDYC | 13 |
| 196 | KDSRNDYCCF | 13 |
| 218 | MPMKLTVNSL | 13 |
| 246 | IKQRKPKLLL | 13 |
| 264 | SSITILKGEI | 13 |

TABLE XLIV-continued

| Pos | 1234567890 | score |
|---|---|---|
| 309 | KTLKIENVSY | 13 |
| 358 | YSTGSNGILL | 13 |
| 450 | ATVVGYSAFL | 13 |
| 473 | WQKVEEVKPL | 13 |
| 507 | SYSCWVENAI | 13 |
| 539 | NPRIPKLHML | 13 |
| 548 | LELHCESKCD | 13 |
| 552 | CESKCDSHLK | 13 |
| 555 | KCDSHLKHSL | 13 |
| 557 | DSHLKHSLKL | 13 |
| 583 | GRIIIDGANL | 13 |
| 666 | EGNKEEPGRW | 13 |
| 748 | WEPLKSMEQN | 13 |
| 761 | LEYRVTWKPQ | 13 |
| 767 | WKPQGAPVEW | 13 |
| 774 | VEWEEETVTN | 13 |
| 778 | EETVTNHTLR | 13 |
| 788 | VMTPAVYAPY | 13 |
| 828 | APVIHGVDVI | 13 |
| 852 | DRVHGRLKGY | 13 |
| 862 | QINWWKTKSL | 13 |
| 879 | KEVNILRFSG | 13 |
| 895 | VPSLDAFSEF | 13 |
| 941 | IKVDKDTATL | 13 |
| 943 | VDKDTATLSW | 13 |
| 957 | KLNGNLTGYL | 13 |
| 990 | SKPSWHLSNL | 13 |
| 996 | LSNLNATTKY | 13 |
| 999 | LNATTKYKFY | 13 |
| 1023 | EESSTLGEGS | 13 |
| 1026 | STLGEGSKGI | 13 |
| 1051 | EVFEPGAEHI | 13 |
| 1079 | IETRGREYAG | 13 |
| 1080 | ETRGREYAGL | 13 |
| 1081 | TRGREYAGLY | 13 |
| 1089 | LYDDISTQGW | 13 |
| 1102 | LMCAIALLTL | 13 |
| 1139 | PEIQSVKDET | 13 |
| 1140 | EIQSVKDETF | 13 |
| 1143 | SVKDETFGEY | 13 |
| 1171 | MQPTESADSL | 13 |
| 1182 | EYGEGDHGLF | 13 |
| 1213 | NGSSTATFPL | 13 |
| | V2-(SET1)-HLA-B4402-10mers-282P1G3<br>Each peptide is a portion of SEQ ID NO: 5; each start position is specified, the length of peptide is 10 amino acids, and the end position for each peptide is the start position plus nine | |
| 1 | EFIVPSVPKF | 17 |
| 9 | KFPKEKIDPL | 15 |
| 6 | SVPKFPKEKI | 11 |
| | V2-(SET2)-HLA-B4402-10mers-282P1G3<br>Each peptide is a portion of SEQ ID NO: 5; each start position is specified, the length of peptide is 10 amino acids, and the end position for each peptide is the start position plus nine. | |
| 9 | EAKENYGKTL | 15 |
| 5 | PKGREAKENY | 11 |
| 8 | REAKENYGKT | 11 |
| 2 | GDLPKGREAK | 7 |
| | V2-(SET3)-HLA-B4402-10mers-282P1G3 | |

TABLE XLIV-continued

| Pos | 1234567890 | score |
|---|---|---|
| | Each peptide is a portion of SEQ ID NO: 5; each start position is specified, the length of peptide is 10 amino acids, and the end position for each peptide is the start position plus nine. | |
| 2 | ESSTLGEGKY | 15 |
| 1 | EESSTLGEGK | 13 |
| 6 | LGEGKYAGLY | 13 |
| 7 | GEGKYAGLYD | 11 |
| 5 | TLGEGKYAGL | 10 |
| 9 | GKYAGLYDDI | 8 |
| | V3-HLA-B4402-10mers-282P1G3<br>Each peptide is a portion of SEQ ID NO: 7; each start position is specified, the length of peptide is 10 amino acids, and the end position for each peptide is the start position plus nine. | |
| 62 | VEKSSTFFKI | 20 |
| 39 | ELSYRNRNML | 15 |
| 49 | AEDFIQKSTS | 15 |
| 23 | ATGSPQPSIF | 14 |
| 24 | TGSPQPSIFI | 13 |
| 31 | IFICSKEQEL | 13 |
| 4 | HGVDVINTTY | 12 |
| 10 | NTTYVSNTTY | 12 |
| 33 | ICSKEQELSY | 12 |
| 36 | QELSYRNRNM | 12 |
| 38 | KEQELSYRNR | 12 |
| 43 | RNRNMLAEDF | 12 |
| 60 | NYVEKSSTFF | 11 |
| 22 | NATGSPQPSI | 10 |
| 52 | FIQKSTSCNY | 10 |
| 44 | NRNMLAEDFI | 9 |
| | V4-HLA-B4402-10mers-282P1G3<br>Each peptide is a portion of SEQ ID NO: 9; each start position is specified, the length of peptide is 10 amino acids, and the end position for each peptide is the start position plus nine. | |
| 7 | GEDLPEQPTF | 23 |
| 8 | EDLPEQPTFL | 17 |
| 1 | SVTLYSGEDL | 12 |
| | V5-HLA B4402-10mers-282P1G3<br>Each peptide is a portion of of SEQ ID NO: 11; each start position is specified, the length of peptide is 10 amino acids, and the end position for each peptide is the start position plus nine. | |
| 4 | KLTVNSSNSI | 10 |
| 7 | VNSSNSIKQR | 7 |
| 10 | SNSIKQRKPK | 5 |
| | V6-HLA-B4402-10mers-282P1G3<br>Each peptide is a portion of SEQ ID NO: 13; each start position is specified, the length of peptide is 10 amino acids, and the end | |

TABLE XLIV-continued

| Pos | 1234567890 | score |
|---|---|---|
| | position for each peptide is the start position plus nine. | |
| 2 | EEIEFIVPKL | 27 |
| 1 | SEEIEFIVPK | 15 |
| 5 | EFIVPKLEHI | 14 |
| 4 | IEFIVPKLEH | 13 |
| | V7-HLA-B4402-10mers-282P1G3 Each peptide is a portion of SEQ ID NO: 15; each start position is specified, the length of peptide is 10 amino acids, and the end position for each peptide is the start position plus nine. | |
| 8 | VEDNISHELF | 23 |
| 21 | PEPPRWTKKP | 18 |
| 10 | DNISHELFTL | 15 |
| 7 | IVEDNISHEL | 12 |
| 17 | FTLHPEPPRW | 12 |
| 14 | HELFTLHPEP | 11 |

TABLE XLV

| Pos | 1234567890 | score |
|---|---|---|
| | V1-HLA-B5101-10mers-282P1G3 | |
| | NoResultsFound. | |
| | V2-(SET1)-HLA-B5101-10mers-282P1G3 | |
| | NoResultsFound. | |
| | V2-(SET2)-HLA-B5101-10mers-282P1G3 | |
| | NoResultsFound. | |
| | V2-(SET3)-HLA-B5101-10mers-282P1G3 | |
| | NoResultsFound. | |
| | V3-HLA B5101-10mers-(SET3)-282P1G3 | |
| | NoResultsFound. | |
| | V4-HLA B5101-10mers-282P1G3 | |
| | NoResultsFound. | |
| | V5-HLA-B5101-10mers-282P1G3 | |
| | NoResultsFound. | |
| | V6-HLA-B5101-10mers-282P1G3 | |
| | NoResultsFound. | |
| | V7- | |

TABLE XLV-continued

| Pos | 1234567890 | score |
|---|---|---|
| | HLA-B5101-10mers-282P1G3 | |
| | NoResultsFound. | |

TABLE XLVI

| Pos | 1234567890 | score |
|---|---|---|
| | V1-DRB1-0101-15mers-282P1G3 Each peptide is a portion of SEQ ID NO: 3; each start position is specified, the length of peptide is 15 amino acids, and the end position for each peptide is the start position plus fourteen. | |
| 263 | ESSITILKGEILLLE | 36 |
| 287 | QVDWNKIGGDLPKGR | 36 |
| 920 | SEPYIFQTPEGVPEQ | 33 |
| 446 | GENYATVVGYSAFLH | 32 |
| 1032 | SKGIGKISGVNLTQK | 32 |
| 1097 | GWFIGLMCAIALLTL | 31 |
| 120 | SEEIEFIVPSVPKLP | 29 |
| 522 | TANLDIRNATKLRVS | 29 |
| 831 | IHGVDVINSTLVKVT | 29 |
| 13 | YLMFLLLKFSKAIEI | 28 |
| 470 | VVSWQKVEEVKPLEG | 28 |
| 104 | QGKYRCFASNKLGIA | 27 |
| 127 | VPSVPKLPKEKIDPL | 27 |
| 461 | CEFFASPEAVVSWQK | 27 |
| 476 | VEEVKPLEGRRYHIY | 27 |
| 940 | VIKVDKDTATLSWGL | 27 |
| 981 | LNDINITTPSKPSWH | 27 |
| 11 | IVYLMFLLLKFSKAI | 26 |
| 16 | FLLLKFSKAIEIPSS | 26 |
| 187 | DLYFANVEEKDSRND | 26 |
| 272 | EILLLECFAEGLPTP | 26 |
| 321 | KGNYRCTASNFLGTA | 26 |
| 539 | NPRIPKLHMLELHCE | 26 |
| 697 | RYQFRVIAVNEVGRS | 26 |
| 742 | KEMIIKWEPLKSMEQ | 26 |
| 748 | WEPLKSMEQNGPGLE | 26 |
| 764 | RVTWKPQGAPVEWEE | 26 |
| 883 | ILRFSGQRNSGMVPS | 26 |
| 1083 | GREYAGLYDDISTQG | 26 |
| 1096 | QGWFIGLMCAIALLT | 26 |
| 1 | MEPLLLGRGLIVYLM | 25 |
| 8 | RGLIVYLMFLLLKFS | 25 |
| 78 | FTDHRIIPSNNSGTF | 25 |
| 112 | SNKLGIAMSEEIEFI | 25 |
| 138 | IDPLEVEEGDPIVLP | 25 |
| 148 | PIVLPCNPPKGLPPL | 25 |
| 163 | HIYWMNIELEHIEQD | 25 |
| 208 | FPRLRTIVQKMPMKL | 25 |
| 354 | QSAVYSTGSNGILLC | 25 |
| 401 | EISFTNLQPNHTAVY | 25 |
| 411 | HTAVYQCEASNVHGT | 25 |
| 509 | SCWVENAIGKTAVTA | 25 |
| 581 | EDGRIIIDGANLTIS | 25 |
| 619 | ITQVTVLDVPDPPEN | 25 |
| 675 | WEELTRVQGKKTTVI | 25 |
| 685 | KTTVILPLAPFVRYQ | 25 |
| 838 | NSTLVKVTWSTVPKD | 25 |
| 905 | HLTVLAYNSKGAGPE | 25 |
| 993 | SWHLSNLNATTKYKF | 25 |
| 1049 | PIEVFEPGAEHIVRL | 25 |
| 1103 | MCAIALLTLLLLTVC | 25 |
| 1108 | LLTLLLLTVCFVKRN | 25 |
| 14 | LMFLLLKFSKAIEIP | 24 |
| 34 | VPTIIKQSKVQVAFP | 24 |
| 123 | IEFIVPSVPKLPKEK | 24 |
| 156 | PKGLPPLHIYWMNIE | 24 |

TABLE XLVI-continued

| Pos | 1234567890 | score |
|---|---|---|
| 178 | ERVYMSQKGDLYFAN | 24 |
| 205 | FAAFPRLRTIVQKMP | 24 |
| 211 | LRTIVQKMPMKLTVN | 24 |
| 243 | ANSIKQRKPKLLLPP | 24 |
| 249 | RKPKLLLPPTESGSE | 24 |
| 328 | ASNFLGTATHDFHVI | 24 |
| 336 | THOFHVIVEEPPRWT | 24 |
| 601 | DQGIYCCSAHTALDS | 24 |
| 693 | APFVRYQFRVIAVNE | 24 |
| 702 | VIAVNEVGRSQPSQP | 24 |
| 745 | IIKWEPLKSMEQNGP | 24 |
| 750 | PLKSMEQNGPGLEYR | 24 |
| 798 | DVKVQAINQLGSGPD | 24 |
| 800 | KVQAINQLGSGPDPQ | 24 |
| 801 | VQAINIQLGSGPDPQS | 24 |
| 839 | STLVKVTWSTVPKDR | 24 |
| 843 | KVTWSTVPKDRVHGR | 24 |
| 852 | DRVHGRLKGYQINWW | 24 |
| 860 | GYQINWWKTKSLLDG | 24 |
| 892 | SGMVPSLDAFSEFHL | 24 |
| 937 | FLKVIKVDKDTATLS | 24 |
| 947 | TATLSWGLPKKLNGN | 24 |
| 956 | KKLNGNLTGYLLQYQ | 24 |
| 975 | TYEIGELNDINITTP | 24 |
| 978 | IGELNDINITTPSKP | 24 |
| 1003 | TKYKFYLRACTSQGC | 24 |
| 1057 | AEHIVRLMTKNWGDN | 24 |
| 1087 | AGLYDDISTQGWFIG | 24 |
| 1105 | AIALLTLLLLTVCFV | 24 |
| 1187 | DHGLFSEDGSFIGAY | 24 |
| 38 | IKQSKVQVAFPFDEY | 23 |
| 89 | SGTFRIPNEGHISHF | 23 |
| 144 | EEGDPIVLPCNPPKG | 23 |
| 153 | CNPPKGLPPLHIYWM | 23 |
| 215 | VQKMPMKLTVNSLKH | 23 |
| 348 | RWTKKPQSAVYSTGS | 23 |
| 351 | KKPQSAVYSTGSNGI | 23 |
| 416 | QCEANSNVHGTILANA | 23 |
| 429 | NANIDVVDVRPLIQT | 23 |
| 486 | RYHIYENGTLQINRT | 23 |
| 532 | KLRVSPKNPRIPKLH | 23 |
| 616 | AADITQVTVLDVPDP | 23 |
| 678 | LTRVQGKKTTVILPL | 23 |
| 733 | NIRVQASQPKEMIIK | 23 |
| 758 | GPGLEYRVTWKPQGA | 23 |
| 796 | PYDVKVQAINQLGSG | 23 |
| 955 | PKKLNGNLTGYLLQY | 23 |
| 1107 | ALLTLLLLTVCFVKR | 23 |
| 1165 | RSLNRDMQPTESADS | 23 |
| 1168 | NRDMQPTESADSLVE | 23 |
| 1204 | SKEKGSVESNGSSTA | 23 |
| 1207 | KGSVESNGSSTATFP | 23 |
| 27 | IPSSVQQVPTIIKQS | 22 |
| 81 | HRIIPSNNSGTFRIP | 22 |
| 132 | KLPKEKIDPLEVEEG | 22 |
| 140 | PLEVEEGDPIVLPCN | 22 |
| 277 | ECFAEGLPTPQVDWN | 22 |
| 376 | PTIKWRVNGSPVDNH | 22 |
| 468 | EAVVSWQKVEEVKPL | 22 |
| 484 | GRRYHIYENGTLQIN | 22 |
| 686 | TTVILPLAPFVRYQF | 22 |
| 705 | VNEVGRSQPSQPSDH | 22 |
| 706 | NEVGRSQPSQPSDHH | 22 |
| 730 | NPQNIRVQASQPKEM | 22 |
| 731 | PQNIRVQASQPKEMI | 22 |
| 783 | NHTLRVMTPAVYAPY | 22 |
| 825 | PDTAPVIHGVDVINS | 22 |
| 828 | APVIHGVDVINSTLV | 22 |
| 878 | PKEVNILRFSGQRNS | 22 |
| 902 | SEFHLTVLAYNSKGA | 22 |
| 973 | NDTYEIGELNDINIT | 22 |
| 1100 | IGLMCAIALLTLLLL | 22 |
| 1102 | LMCAIALLTLLLLTV | 22 |
| 1138 | DPEIQSVKDETFGEY | 22 |
| 346 | PPRWTKKPQSAVYST | 21 |
| 391 | PFAGDVVFPREISFT | 21 |
| 431 | NIDVVDVRPLIQTKD | 21 |

TABLE XLVI-continued

| Pos | 1234567890 | score |
|---|---|---|
| 529 | NATKLRVSPKNPRIP | 21 |
| 641 | NRSVRLTWEAGADHN | 21 |
| 683 | GKKTTVILPLAPFVR | 21 |
| 881 | VNILRFSGQRNSGMV | 21 |
| 889 | QRNSGMVPSLDAFSE | 21 |
| 1095 | TQGWFIGLMCAIALL | 21 |
| 1166 | SLNRDMQPTESADSL | 21 |
| 1198 | IGAYAGSKEKGSVES | 21 |
| 10 | LIVYLMFLLLKFSKA | 20 |
| 18 | LLKFSKAIEIPSSVQ | 20 |
| 28 | PSSVQQVPTIIKQSK | 20 |
| 44 | QVAFPFDEYFQIECE | 20 |
| 73 | GNPFYFTDHRIIPSN | 20 |
| 109 | CFASNKLGIAMSEEI | 20 |
| 362 | SNGILLCEAEGEPQP | 20 |
| 421 | NVHGTILANANIDVV | 20 |
| 434 | VVDVRPLIQTKDGEN | 20 |
| 473 | WQKVEEVKPLEGRRY | 20 |
| 572 | GEAFEINGTEDRII | 20 |
| 582 | DGRIIIDGANLTISN | 20 |
| 593 | TISNVTLEDQGIYCC | 20 |
| 684 | KKTTVILPLAPFVRY | 20 |
| 692 | LAPFVRYQFRVIAVN | 20 |
| 782 | TNHTLRVMTPAVYAP | 20 |
| 908 | VLAYNSKGAGPESEP | 20 |
| 928 | PEGVPEQPTFLKVIK | 20 |
| 966 | LLQYQIINDTYEIGE | 20 |
| 1039 | SGVNLTQKTHPIEVF | 20 |
| 1117 | CFVKRNRGGKYSVKE | 20 |
| 32 | QQVPTIIKQSKVQVA | 19 |
| 75 | PFYFTDHRIIPSNNS | 19 |
| 122 | EIEFIVPSVPKLPKE | 19 |
| 265 | SITILKGEILLLECF | 19 |
| 268 | ILKGEILLLECFAEG | 19 |
| 377 | TIKWRVNGSPVDNHP | 19 |
| 455 | YSAFLHCEFFASPEA | 19 |
| 602 | QGIYCCSAHTALDSA | 19 |
| 659 | SEYIVEFEGNKEEPG | 19 |
| 898 | LDAFSEFHLTVLAYN | 19 |
| 922 | PYIFQTPEGVPEQPT | 19 |
| 932 | PEQPTFLKVIKVDKD | 19 |
| 952 | WGLPKKLNGNLTGYL | 19 |
| 1028 | LGEGSKGIGKISGVN | 19 |
| 1038 | ISGVNLTQKTHPIEV | 19 |
| 1061 | VRLMTKNWGDNDSIF | 19 |
| 1106 | IALLTLLLLTVCFVK | 19 |
| 1124 | GGKYSVKEKEDLHPD | 19 |
| 1149 | FGEYSDSDEKPLKGS | 19 |
| 4 | LLLGRGLIVYLMFLL | 18 |
| 64 | EPTFSWTKDGNPFYF | 18 |
| 74 | NPFYFTDHRIIPSNN | 18 |
| 100 | ISHFQGKYRCFASNK | 18 |
| 107 | YRCFASNKLGIAMSE | 18 |
| 114 | KLGIAMSEEIEFIVP | 18 |
| 130 | VPKLPKEKIDPLEVE | 18 |
| 199 | RNDYCCFAAFPRLRT | 18 |
| 209 | PRLRTIVQKMPMKLT | 18 |
| 216 | QKMPMKLTVNSLKHA | 18 |
| 219 | PMKLTVNSLKHANDS | 18 |
| 251 | PKLLLPPTESGSESS | 18 |
| 270 | KGEILLLECFAEGLP | 18 |
| 300 | GRETKENYGKTLKIE | 18 |
| 355 | SAVYSTGSNGILLCE | 18 |
| 393 | AGDVVFPREISFTNL | 18 |
| 452 | VVGYSAFLHCEFFAS | 18 |
| 460 | HCEFFASPEAVVSWQ | 18 |
| 492 | NGTLQINRTTEEDAG | 18 |
| 505 | AGSYSCWVENAIGKT | 18 |
| 524 | NLDIRNATKLRVSPK | 18 |
| 542 | IPKLHMLELHCESKC | 18 |
| 566 | LSWSKDGEAFEINGT | 18 |
| 574 | AFEINGTEDGRIIID | 18 |
| 645 | RLTWEAGADHNSNIS | 18 |
| 672 | PGRWEELTRVQGKKTT | 18 |
| 743 | EMIIKWEPLKSMEQN | 18 |
| 763 | YRVTWKPQGAPVEWE | 18 |
| 778 | EETVTNHTLRVMTPA | 18 |

TABLE XLVI-continued

| Pos | 1234567890 | score |
|---|---|---|
| 784 | HTLRVMTPAVYAPYD | 18 |
| 813 | PQSVTLYSGEDYPDT | 18 |
| 862 | QINWWKTKSLLDGRT | 18 |
| 866 | WKTKSLLDGRTHPKE | 18 |
| 907 | TVLAYNSKGAGPESE | 18 |
| 909 | LAYNSKGAGPESEPY | 18 |
| 934 | QPTFLKVIKVDKDTA | 18 |
| 951 | SWGLPKKLNGNLTGY | 18 |
| 979 | GELNDINITTPSKPS | 18 |
| 996 | LSNLNATTKYKFYLR | 18 |
| 1006 | KFYLRACTSQGCGKP | 18 |
| 1021 | ITEESSTLGEGSKGI | 18 |
| 1050 | IEVFEPGAEHIVRLIM | 18 |
| 1024 | ESSTLGEGSKGIGKI | 18 |
| 1116 | VCFVKRNRGGKYSVK | 18 |
| 1126 | KYSVKEKEDLHPDPE | 18 |
| 1161 | KGSLRSLNRDMQPTE | 18 |
| 1180 | LVEYGEGDHGLFSED | 18 |
| 1194 | DGSFIGAYAGSKEKG | 18 |
| 6 | LGRGLIVYLMFLLLK | 17 |
| 12 | VYLMFLLLKFSKAIE | 17 |
| 20 | KFSKAIEIPSSVQQV | 17 |
| 22 | SKAIEIPSSVQQVPT | 17 |
| 35 | PTIIKQSKVQVAFPF | 17 |
| 42 | KVQVAFPFDEYFQIE | 17 |
| 49 | FDEYFQIECEAKGNP | 17 |
| 90 | GTFRIPNEGHISHFQ | 17 |
| 97 | EGHISHFQGKYRCFA | 17 |
| 135 | KEKIDPLEVEEGDPI | 17 |
| 150 | VLPCNPPKGLPPLHI | 17 |
| 171 | LEHIEQDERVYMSQK | 17 |
| 177 | DERVYMSQKGDLYFA | 17 |
| 179 | RVYMSQKGDLYFANV | 17 |
| 212 | RTIVQKMPMKLTVNS | 17 |
| 221 | KLTVNSLKHANDSSS | 17 |
| 222 | LTVNSLKHANDSSSS | 17 |
| 224 | VNSLKHANDSSSSTE | 17 |
| 232 | DSSSSTEIGSKANSI | 17 |
| 240 | GSKANSIKQRKPKLL | 17 |
| 242 | KANSIKQRKPKLLLP | 17 |
| 269 | LKGEILLLECFAEGL | 17 |
| 276 | LECFAEGLPTPQVDW | 17 |
| 290 | WNKIGGDLPKGRETK | 17 |
| 305 | ENYGKTLKIENVSYQ | 17 |
| 326 | CTASNFLGTATHDFH | 17 |
| 356 | AVYSTGSNGILLCEA | 17 |
| 364 | GILLCEAEGEPQPTI | 17 |
| 375 | QPTIKWRVNGSPVDN | 17 |
| 385 | SPVDNHPFAGDWFP | 17 |
| 396 | VVFPREISFTNLQPN | 17 |
| 442 | QTKDGENYATVVGYS | 17 |
| 453 | VGYSAFLHCEFFASP | 17 |
| 449 | YATVVGYSAFLHCEF | 17 |
| 494 | TLQINRTTEEDAGSY | 17 |
| 510 | CWVENAIGKTAVTAN | 17 |
| 519 | TAVTANLDIRNATKL | 17 |
| 561 | KHSLKLSWSKDGEAF | 17 |
| 575 | FEINGTEDGRIIIDG | 17 |
| 584 | RIIIDGANLTISNVT | 17 |
| 608 | SAHTALDSAADITQV | 17 |
| 633 | NLHLSERQNRSVRLT | 17 |
| 643 | SVRLTWEAGADHNSN | 17 |
| 700 | FRVIAVNEVGRSQPS | 17 |
| 740 | QPKEMIIKWEPLKSM | 17 |
| 761 | LEYRVTWKPQGAPVE | 17 |
| 762 | EYRVTWKPQGAPVEW | 17 |
| 790 | TPAVYAPYDVKVQAI | 17 |
| 795 | APYDVKVQAINQLGS | 17 |
| 802 | QAINQLGSGPDPQSV | 17 |
| 833 | GVDVINSTLVKVTWS | 17 |
| 836 | VINSTLVKVTWSTVP | 17 |
| 891 | NSGMVPSLDAFSEFH | 17 |
| 903 | EFHLTVLAYNSKGAG | 17 |
| 943 | VDKDTATLSWGLPKK | 17 |
| 961 | NLTGYLLQYQIINDT | 17 |
| 962 | LTGYLLQYQIINDTY | 17 |
| 967 | LQYQIINDTYEIGEL | 17 |

TABLE XLVI-continued

| Pos | 1234567890 | score |
|---|---|---|
| 1009 | LRACTSQGCGKPITE | 17 |
| 1010 | RACTSQGCGKPITEE | 17 |
| 1058 | EHIVRLMTKNWGDND | 17 |
| 1072 | DSIFQDVIETRGREY | 17 |
| 1075 | FQDVIETRGREYAGL | 17 |
| 1076 | QDVIETRGREYAGLY | 17 |
| 1154 | DSDEKPLKGSLRSLN | 17 |
| 1178 | DSLVEYGEGDHGLFS | 17 |
| 1188 | HGLFSEDGSFIGAYA | 17 |
| 1195 | GSFIGAYAGSKEKGS | 17 |
| 1210 | VESNGSSTATFPLRA | 17 |

V2-(SET1)-HLA-DRB1-0101-15MERS-282P1G3
Each peptide is a portion of SEQ ID NO: 5; each start position is specified, the length of peptide is 15 amino acids, and the end position for each peptide is the start position plus fourteen.

| Pos | 1234567890 | score |
|---|---|---|
| 2 | SEEIEFIVPSVPKFP | 29 |
| 5 | IEFIVPSVPKFPKEK | 24 |
| 14 | KFPKEKIDPLEVEEG | 22 |
| 12 | VPKFPKEKIDPLEVE | 20 |
| 4 | EIEFIVPSVPKFPKE | 19 |
| 9 | VPSVPKFPKEKIDPL | 19 |
| 3 | EEIEFIVPSVPKFPK | 15 |
| 6 | EFIVPSVPKFPKEKI | 14 |

V2-(SET2)-HLA-DRB1-0101-15mers-282P1G3
Each peptide is a portion of SEQ ID NO: 5; each start position is specified, the length of peptide is 15 amino acids, and the end position for each peptide is the start position plus fourteen.

| Pos | 1234567890 | score |
|---|---|---|
| 4 | KIGGDLPKGREAKEN | 18 |
| 12 | GREAKENYGKTLKIE | 18 |
| 2 | WNKIGGDLPKGREAK | 17 |
| 14 | EAKENYGKTLKIENV | 16 |
| 6 | GGDLPKGREAKENYG | 11 |
| 7 | GDLPKGREAKENYGK | 11 |
| 3 | NKIGGDLPKGREAKE | 8 |

V2-(SET3)-HLA-DRB1-0101-15mers-282P1G3
Each peptide is a portion of SEQ ID NO: 5; each start position is specified, the length of peptide is 15 amino acids, and the end position for each peptide is the start position plus fourteen.

| Pos | 1234567890 | score |
|---|---|---|
| 13 | EGKYAGLYDDISTQG | 26 |
| 6 | EESSTLGEGKYAGLY | 20 |
| 8 | SSTLGEGKYAGLYDD | 18 |
| 1 | GKPITEESSTLGEGK | 16 |

V3-HLA-DRB1-0101-15mers-282P1G3
Each peptide is a portion of SEQ ID NO: 7; each start position is specified, the length of peptide is 15 amino acids, and the end position for each peptide is the start position plus fourteen.

| Pos | 1234567890 | score |
|---|---|---|
| 8 | IHGVDVINTTYVSNT | 29 |
| 15 | NTTYVSNTTYVSNAT | 25 |
| 21 | NTTYVSNATGSPQPS | 25 |
| 46 | SYRNRNMLAEDFIQK | 24 |
| 2 | PDTAPVIHGVDVINT | 22 |
| 27 | NATGSPQPSIFICSK | 20 |
| 20 | SNTTYVSNATGSPQP | 19 |
| 9 | HGVDVINTTYVSNTT | 18 |
| 34 | PSIFICSKEQELSYR | 18 |
| 47 | YRNRNMLAEDFIQKS | 18 |
| 35 | SIFICSKEQELSYRN | 17 |

TABLE XLVI-continued

| Pos | 1234567890 | score |
|---|---|---|
| 50 | RNMLAEDFIQKSTSC | 17 |
| 22 | TTYVSNATGSPQPSI | 16 |
| 23 | TYVSNATGSPQPSIF | 16 |
| 42 | EQELSYRNRNMLAED | 16 |
| 53 | LAEDFIQKSTSCNYV | 16 |
| 54 | AEDFIQKSTSCNYVE | 16 |
| 55 | EDFIQKSTSCNYVEK | 16 |
| 14 | INTTYVSNTTYVSNA | 15 |
| 52 | MLAEDFIQKSTSCNY | 15 |
| 5 | APVIHGVDVINTTYV | 14 |
| 24 | YVSNATGSPQPSIFI | 14 |
| 26 | SNATGSPQPSIFICS | 14 |
| 32 | PQPSIFICSKEQELS | 14 |
| 62 | TSCNYVEKSSTFFKI | 14 |
| | V4-HLA-DRB1-0101-15mers-282P1G3<br>Each peptide is a portion of SEQ ID NO: 9; each start position is specified, the length of peptide is 15 amino acids, and the end position for each peptide is the start position plus fourteen. | |
| 4 | PQSVTLYSGEDLPEQ | 26 |
| 12 | GEDLPEQPTFLKVIK | 20 |
| 3 | DPQSVTLYSGEDLPE | 15 |
| 11 | SGEDLPEQPTFLKVI | 15 |
| 8 | TLYSGEDLPEQPTFL | 14 |
| | V5-HLA-DRB1-0101-15mers-282P1G3<br>Each peptide is a portion of SEQ ID NO: 11; each start position is specified, the length of peptide is 15 amino acids, and the end position for each peptide is the start position plus fourteen. | |
| 15 | SNSIKQRKPKLLLPP | 24 |
| 3 | VQKMPMKLTVNSSNS | 23 |
| 7 | PMKLTVNSSNSIKQR | 23 |
| 6 | MPMKLTVNSSNSIKQ | 20 |
| 4 | QKMPMKLTVNSSNSI | 18 |
| 12 | VNSSNSIKQRKPKLL | 17 |
| 14 | SSNSIKQRKPKLLLP | 17 |
| 9 | KLTVNSSNSIKQRKP | 16 |
| | V6-HLA-DRB1-0101-15mers-282P1G3<br>Each peptide is a portion of SEQ ID NO: 13; each start position is specified, the length of peptide is 15 amino acids, and the end position for each peptide is the start position plus fourteen. | |
| 6 | SEEIEFIVPKLEHIE | 22 |
| 10 | EFIVPKLEHIEQDER | 19 |
| 8 | EIEFIVPKLEHIEQD | 18 |
| 2 | GIAMSEEIEFIVPKL | 16 |
| 3 | IAMSEEIEFIVPKLE | 15 |
| 13 | VPKLEHIEQDERVYM | 15 |
| 14 | PKLEHIEQDERVYMS | 11 |
| | V7-HLA-DRB1-0101-15mers-282P1G3<br>Each peptide is a portion of SEQ ID NO: 15; each start position is specified, the length of peptide is 15 amino acids, and the end position for each peptide is the start position plus fourteen. | |
| 18 | SHELFTLHPEPPRWT | 30 |
| 6 | THDFHVIVEDNISHE | 24 |
| 10 | HVIVEDNISHELFTL | 22 |
| 15 | DNISHELFTLHPEPP | 22 |
| 7 | HDFHVIVEDNISHEL | 19 |
| 24 | LHPEPPRWTKKPQSA | 16 |
| 21 | LFTLHPEPPRWTKKP | 15 |
| 11 | VIVEDNISHELFTLH | 14 |

TABLE XLVII

| Pos | 123456789012345 | score |
|---|---|---|
| | V1-HLA-DRB1-0301-15mers-282P1G3<br>Each peptide is a portion of SEQ ID NO: 3; each start position is specified, the length of peptide is 15 amino acids, and the end position for each peptide is the start position plus fourteen. | |
| 171 | LEHIEQDERVYMSQK | 28 |
| 1132 | KEDLHPDPEIQSVKD | 28 |
| 66 | TFSWTKDGNPFYFTD | 26 |
| 114 | KLGIAMSEEIEFIVP | 26 |
| 191 | ANVEEKDSRNDYCCF | 26 |
| 594 | ISNVTLEDQGIYCCS | 26 |
| 951 | SWGLPKKLNGNLTGY | 26 |
| 1164 | LRSLNRDMQPTESAD | 26 |
| 177 | DERVYMSQKGDLYFA | 25 |
| 313 | IENVSYQDKGNYRCT | 25 |
| 393 | AGDVVFPREISFTNL | 25 |
| 689 | ILPLAPFVRYQFRVI | 25 |
| 895 | VPSLDAFSEFHLTVL | 25 |
| 996 | LSNLNATTKYKFYLR | 25 |
| 582 | DGRIIIDGANLTISN | 24 |
| 265 | SITILKGEILLLECF | 23 |
| 938 | LKVIKVDKDTATLSW | 23 |
| 623 | TVLDVPDPPENLHLS | 22 |
| 2 | EPLLLGRGLIVYLMF | 21 |
| 7 | GRGLIVYLMFLLLKF | 21 |
| 8 | RGLIVYLMFLLLKFS | 21 |
| 243 | ANSIKQRKPKLLLPP | 21 |
| 272 | EILLLECFAEGLPTP | 21 |
| 290 | WNKIGGDLPKGRETK | 21 |
| 476 | VEEVKPLEGRRYHIY | 21 |
| 687 | TVILPLAPFVRYQFR | 21 |
| 786 | LRVMTPAVYAPYDVK | 21 |
| 813 | PQSVTLYSGEDYPDT | 21 |
| 940 | VIKVDKDTATLSWGL | 21 |
| 968 | QYQIINDTYEIGELN | 21 |
| 1032 | SKGIGKISGVNLTQK | 21 |
| 1103 | MCAIALLTLLLLTVC | 21 |
| 3 | PLLLGRGLIVYLMFL | 20 |
| 15 | MFLLLKFSKAIEIPS | 20 |
| 179 | RVYMSQKGDLYFANV | 20 |
| 211 | LRTIVQKMPMKLTVN | 20 |
| 263 | ESSITILKGEILLLE | 20 |
| 404 | FTNLQPNHTAVYQCE | 20 |
| 631 | PENLHLSERQNRSVR | 20 |
| 748 | WEPLKSMEQNGPGLE | 20 |
| 783 | NHTLRVMTPAVYAPY | 20 |
| 796 | PYDVKVQAINQLGSG | 20 |
| 846 | WSTVPKDRVHGRLKG | 20 |
| 867 | KTKSLLDGRTHPKEV | 20 |
| 947 | TATLSWGLPKKLNGN | 20 |
| 1071 | NDSIFQDVIETRGRE | 20 |
| 1075 | FQDVIETRGREYAGL | 20 |
| 1086 | YAGLYDDISTQGWFI | 20 |
| 1097 | GWFIGLMCAIALLTL | 20 |
| 1116 | VCFVKRNRGGKYSVK | 20 |
| 1138 | DPEIQSVKDETFGEY | 20 |
| 1172 | QPTESADSLVEYGEG | 20 |
| 1188 | HGLFSEDGSFIGAYA | 20 |
| 34 | VPTIIKQSKVQVAFP | 19 |
| 44 | QVAFPFDEYFQIECE | 19 |
| 81 | HRIIPSNNSGTFRIP | 19 |
| 122 | EIEFIVPSVPKLPKE | 19 |
| 124 | EFIVPSVPKLPKEKI | 19 |
| 130 | VPKLPKEKIDPLEVE | 19 |

TABLE XLVII-continued

| Pos | 123456789012345 | score |
|---|---|---|
| 140 | PLEVEEGDPIVLPCN | 19 |
| 148 | PIVLPCNPPKGLPPL | 19 |
| 217 | KMPMKLTVNSLKHAN | 19 |
| 251 | PKLLLPPTESGSESS | 19 |
| 434 | VVDVRPLIQTKDGEN | 19 |
| 438 | RPLIQTKDGENYATV | 19 |
| 439 | PLIQTKDGENYATVV | 19 |
| 467 | PEAVVSWQKVEEVKP | 19 |
| 520 | AVTANLDIRNATKLR | 19 |
| 522 | TANLDIRNATKLRVS | 19 |
| 530 | ATKLRVSPKNPRIPK | 19 |
| 539 | NPRIPKLHMLELHCE | 19 |
| 557 | DSHLKHSLKLSWSKD | 19 |
| 576 | EINGTEDGRIIIDGA | 19 |
| 624 | VLDVPDPPENLHLSE | 19 |
| 641 | NRSVRLTWEAGADHN | 19 |
| 762 | EYRVTWKPQGAPVEW | 19 |
| 860 | GYQINWWKTKSLLDG | 19 |
| 881 | VNILRFSGQRNSGMV | 19 |
| 893 | GMVPSLDAFSEFHLT | 19 |
| 955 | PKKLNGNLTGYLLQY | 19 |
| 1058 | EHIVRLMTKNWGDND | 19 |
| 1100 | IGLMCAIALLTLLLL | 19 |
| 1141 | IQSVKDETFGEYSDS | 19 |
| 1150 | GEYSDSDEKPLKGSL | 19 |
| 1157 | EKPLKGSLRSLNRDM | 19 |
| 1177 | ADSLVEYGEGDHGLF | 19 |
| 12 | VYLMFLLLKFSKAIE | 18 |
| 24 | AIEIPSSVQQVPTII | 18 |
| 42 | KVQVAFPFDEYFQIE | 18 |
| 80 | DHRIIPSNNSGTFRI | 18 |
| 127 | VPSVPKLPKEKIDPL | 18 |
| 146 | GDPIVLPCNPPKGLP | 18 |
| 264 | SSITILKGEILLLEC | 18 |
| 307 | YGKTLKIENVSYQDK | 18 |
| 328 | ASNFLGTATHDFHVI | 18 |
| 340 | HVIVEEPPRWTKKPQ | 18 |
| 363 | NGILLCEAEGEPQPT | 18 |
| 389 | NHPFAGDWFPREIS | 18 |
| 423 | HGTILANANIDVVDV | 18 |
| 429 | NANIDVVDVRPLIQT | 18 |
| 430 | ANIDVVDVRPLIQTK | 18 |
| 479 | VKPLEGRRYHIYENG | 18 |
| 524 | NLDIRNATKLRVSPK | 18 |
| 545 | LHMLELHCESKCDSH | 18 |
| 565 | KLSWSKDGEAFEING | 18 |
| 583 | GRIIIDGANLTISNV | 18 |
| 588 | DGANLTISNVTLEDQ | 18 |
| 693 | APFVRYQFRVIAVNE | 18 |
| 699 | QFRVIAVNEVGRSQP | 18 |
| 702 | VIAVNEVGRSQPSQP | 18 |
| 741 | PKEMIIKWEPLKSME | 18 |
| 806 | QLGSGPDPQSVTLYS | 18 |
| 906 | LTVLAYNSKGAGPES | 18 |
| 977 | EIGELNDINITTPSK | 18 |
| 983 | DINITTPSKPSWHLS | 18 |
| 1025 | SSTLGEGSKGIGKIS | 18 |
| 1064 | MTKNWGDNDSIFQDV | 18 |
| 1113 | LLTVCFVKRNRGGKY | 18 |
| 1161 | KGSLRSLNRDMQPTE | 18 |
| 31 | VQQVPTIIKQSKVQV | 17 |
| 36 | TIIKQSKVQVAFPFD | 17 |
| 52 | YFQIECEAKGNPEPT | 17 |
| 96 | NEGHISHFQGKYRCF | 17 |
| 116 | GIAMSEEIEFIVPSV | 17 |
| 164 | IYWMNIELEHIEQDE | 17 |
| 168 | NIELEHIEQDERVYM | 17 |
| 208 | FPRLRTIVQKMPMKL | 17 |
| 236 | STEIGSKANSIKQRK | 17 |
| 244 | NSIKQRKPKLLLPPT | 17 |
| 273 | ILLLECFAEGLPTPQ | 17 |
| 294 | GGDLPKGRETKENYG | 17 |
| 375 | QPTIKWRVNGSPVDN | 17 |
| 547 | MLELHCESKCDSHLK | 17 |
| 625 | LDVPDPPENLHLSER | 17 |
| 633 | NLHLSERQNRSVRLT | 17 |
| 647 | TWEAGADHNSNISEY | 17 |

TABLE XLVII-continued

| Pos | 123456789012345 | score |
|---|---|---|
| 660 | EYIVEFEGNKEEPGR | 17 |
| 722 | TPPAAPDRNPQNIRV | 17 |
| 771 | GAPVEWEEETVTNHT | 17 |
| 792 | AVYAPYDVKVQAINQ | 17 |
| 798 | DVKVQAINQLGSGPD | 17 |
| 851 | KDRVHGRLKGYQINW | 17 |
| 898 | LDAFSEFHLTVLAYN | 17 |
| 921 | EPYIFQTPEGVPEQP | 17 |
| 934 | QPTFLKVIKVDKDTA | 17 |
| 937 | FLKVIKVDKDTATLS | 17 |
| 1038 | ISGVNLTQKTHPIEV | 17 |
| 1076 | QDVIETRGREYAGLY | 17 |
| 50 | DEYFQIECEAKGNPE | 16 |
| 56 | ECEAKGNPEPTFSWT | 16 |
| 74 | NPFYFTDHRIIPSNN | 16 |
| 170 | ELEHIEQDERVYMSQ | 16 |
| 202 | YCCFAAFPRLRTIVQ | 16 |
| 242 | KANSIKQRKPKLLLP | 16 |
| 283 | LPTPQVDWNKIGGDL | 16 |
| 460 | HCEFFASPEAVVSWQ | 16 |
| 494 | TLQINRTTEEDAGSY | 16 |
| 553 | ESKCDSHLKHSLKLS | 16 |
| 969 | YQIINDTYEIGELND | 16 |
| 46 | AFPFDEYFQIECEAK | 15 |
| 89 | SGTFRIPNEGHISHF | 15 |
| 160 | PPLHIYWMNIELEHI | 15 |
| 187 | DLYFANVEEKDSRND | 15 |
| 270 | KGEILLLECFAEGLP | 15 |
| 296 | DLPKGRETKENYGKT | 15 |
| 355 | SAVYSTGSNGILLCE | 15 |
| 381 | RVNGSPVDNHPFAGD | 15 |
| 484 | GRRYHIYENGTLQIN | 15 |
| 659 | SEYIVEFEGNKEEPG | 15 |
| 662 | IVEFEGNKEEPGRWE | 15 |
| 830 | VIHGVDVINSTLVKV | 15 |
| 861 | YQINWWKTKSLLDGR | 15 |
| 926 | QTPEGVPEQPTFLKV | 15 |
| 998 | NLNATTKYKFYLRAC | 15 |
| 1050 | IEVFEPGAEHIVRLM | 15 |
| 1115 | TVCFVKRNRGGKYSV | 15 |
| 1124 | GGKYSVKEKEDLHPD | 15 |
| 1153 | SDSDEKPLKGSLRSL | 15 |
| 1 | MEPLLLGRGLIVYLM | 14 |
| 10 | LIVYLMFLLLKFSKA | 14 |
| 14 | LMFLLLKFSKAIEIP | 14 |
| 18 | LLKFSKAIEIPSSVQ | 14 |
| 100 | ISHFQGKYRCFASNK | 14 |
| 147 | DPIVLPCNPPKGLPP | 14 |
| 215 | VQKMPMKLTVNSLKH | 14 |
| 221 | KLTVNSLKHANDSSS | 14 |
| 250 | KPKLLLPPTESGSES | 14 |
| 271 | GEILLLECFAEGLPT | 14 |
| 336 | THDFHVIVEEPPRWT | 14 |
| 362 | SNGILLCEAEGEPQP | 14 |
| 551 | HCESKCDSHLKHSLK | 14 |
| 742 | KEMIIKWEPLKSMEQ | 14 |
| 775 | EWEEETVTNHTLRVM | 14 |
| 880 | EVNILRFSGQRNSGM | 14 |
| 883 | ILRFSGQRNSGMVPS | 14 |
| 891 | NSGMVPSLDAFSEFH | 14 |
| 965 | YLLQYQIINDTYEIG | 14 |
| 1018 | GKPITEESSTLGEGS | 14 |
| 1072 | DSIFQDVIETRGREY | 14 |
| 1088 | GLIDDISTQGWFIGL | 14 |
| 1105 | AIALLTLLLLTVCFV | 14 |
| 1110 | TLLLLTVCFVKRNRG | 14 |
| 1126 | KYSVKEKEDLHPDPE | 14 |
| 1149 | FGEYSDSDEKPLKGS | 14 |
| 9 | GLIVYLMFLLLKFSK | 13 |
| 13 | YLMFLLLKFSKAIEI | 13 |
| 35 | PTIIKQSKVQVAFPF | 13 |
| 123 | IEFIVPSVPKLPKEK | 13 |
| 141 | LEVEEGDPIVLPCNP | 13 |
| 181 | YMSQKGDLFANVEE | 13 |
| 266 | ITILKGEILLLECFA | 13 |
| 339 | FHVIVEEPPRWTKKP | 13 |
| 354 | QSAVYSTGSNGILLC | 13 |

TABLE XLVII-continued

| Pos | 123456789012345 | score |
|---|---|---|
| 449 | YATVVGYSAFLHCEF | 13 |
| 473 | WQKVEEVKPLEGRRY | 13 |
| 486 | RYHIYENGTLQINRT | 13 |
| 544 | KLHMLELHCESKCDS | 13 |
| 595 | SNVTLEDQGIYCCSA | 13 |
| 608 | SAHTALDSAADITQV | 13 |
| 621 | QVTVLDVPDPPENLH | 13 |
| 685 | KTTVILPLAPFVRYQ | 13 |
| 686 | TTVILPLAPFVRYQF | 13 |
| 833 | GVDVINSTLVKVTWS | 13 |
| 928 | PEGVPEQPTFLKVIK | 13 |
| 935 | PTFLKVIKVDKDTAT | 13 |
| 959 | NGNLTGYLLQYQIIN | 13 |
| 963 | TGYLLQYQIINDTYE | 13 |
| 1098 | WFIGLMCAIALLTLL | 13 |
| 1106 | IALLTLLLLTVCFVK | 13 |
| 1107 | ALLTLLLLTVCFVKR | 13 |
| 1108 | LLTLLLLTVCFVKRN | 13 |
| 1109 | LTLLLLTVCFVKRNR | 13 |
| 1128 | SVKEKEDLHPDPEIQ | 13 |
| 1148 | TFGEYSDSDEKPLKG | 13 |
| 1168 | NRDMQPTESADSLVE | 13 |
| | V2-(SET1)-HLA-DRB1-0301-15mers-282P1G3 Each peptide is a portion of SEQ ID NO: 5; each start position is specified, the length of peptide is 15 amino acids, and the end position for each peptide is the start position plus fourteen. | |
| 4 | EIEFIVPSVPKFPKE | 19 |
| 6 | EF IVPSVPKFPKEKI | 18 |
| 9 | VPSVPKFPKEKIDPL | 18 |
| 12 | VPKFPKEKIDPLEVE | 17 |
| 5 | IEFIVPSVPKFPKEK | 12 |
| 15 | FPKEKIDPLEVEEGD | 12 |
| 2 | SEEIEFIVPSVPKFP | 10 |
| | V2-(SET2)-HLA-DRB1-0301-15mers-282P1G3 Each peptide is a portion of SEQ ID NO: 5; each start position is specified, the length of peptide is 15 amino acids, and the end position for each peptide is the start position plus fourteen. | |
| 2 | WNKIGGDLPKGREAK | 21 |
| 6 | GGDLPKGREAKENYG | 18 |
| 8 | DLPKGREAKENYGKT | 15 |
| 5 | IGGDLPKGREAKENY | 11 |
| 9 | LPKGREAKENYGKTL | 10 |
| 12 | GREAKENYGKTLKIE | 10 |
| | V2-(SET3)-HLA-DRB1-0301-15mers-282P1G3 Each peptide is a portion of SEQ ID NO: 5; each start position is specified, the length of peptide is 15 amino acids, and the end position for each peptide is the start position plus fourteen. | |
| 8 | SSTLGEGKYAGLYDD | 21 |
| 5 | TEESSTLGEGKYAGL | 16 |
| 1 | GKPITEESSTLGEGK | 14 |
| 15 | KYAGLYDDISTQGWF | 12 |
| 7 | ESSTLGEGKYAGLYD | 10 |
| | V3-HLA-DRB1-0301-15mers-282P1G3 Each peptide is a portion of SEQ ID NO: 7; each start position is specified, the length of peptide is 15 amino acids, and the end position for each peptide is the start position plus fourteen. | |
| 34 | PSIFICSKEQELSYR | 25 |

TABLE XLVII-continued

| Pos | 123456789012345 | score |
|---|---|---|
| 42 | EQELSYRNRNMLAED | 25 |
| 50 | RNMLAEDFIQKSTSC | 23 |
| 35 | SIFICSKEQELSYRN | 19 |
| 55 | EDFIQKSTSCNYVEK | 19 |
| 33 | QPSIFICSKEQELSY | 17 |
| 13 | VINTTYVSNTTYVSN | 16 |
| 7 | VIHGVDVINTTYVSN | 15 |
| 36 | IFICSKEQELSYRNR | 15 |
| 4 | TAPVIHGVDVINTTY | 12 |
| 10 | GVDVINTTYVSNTTY | 12 |
| 49 | NRMLAEDFIQKSTS | 12 |
| | V4-HLA-DRB1-0301-15mers-282P1G3 Each peptide is a portion of SEQ ID NO: 9; each start position is specified, the length of peptide is 15 amino acids, and the end position for each peptide is the start position plus fourteen. | |
| 4 | PQSVTLYSGEDLPEQ | 21 |
| 10 | YSGEDLPEQPTFLKV | 16 |
| 6 | SVTLYSGEDLPEQPT | 13 |
| 12 | GEDLPEQPTFLKVIK | 13 |
| 8 | TLYSGEDLPEQPTFL | 12 |
| 11 | SGEDLPEQPTFLKVI | 11 |
| 5 | QSVTLYSGEDLPEQP | 10 |
| | V5-HLA-DRB1-0301-15mers-282P1G3 Each peptide is a portion of SEQ ID NO: 11; each start position is specified, the length of peptide is 15 amino acids, and the end position for each peptide is the start position plus fourteen. | |
| 15 | SNSIKQRKPKLLLPP | 21 |
| 5 | KMPMKLTVNSSNSIK | 18 |
| 14 | SSNSIKQRKPKLLLP | 16 |
| 3 | VQKMPMKLTVNSSNS | 14 |
| 7 | PMKLTVNSSNSIKQR | 13 |
| 9 | KLTVNSSNSIKQRKP | 12 |

TABLE XLVIII

| Pos | 123456789012345 | score |
|---|---|---|
| | V2-(SET1)-HLA-0401-15mers-282P1G3 Each peptide is a portion of SEQ ID NO: 5; each start position is specified, the length of peptide is 15 amino acids, and the end position for each peptide is the start position plus fourteen. | |
| 12 | VPKFPKEKIDPLEVE | 22 |
| 6 | EFIVPSVPKFPKEKI | 20 |
| 9 | VPSVPKFPKEKIDPL | 20 |
| 3 | EEIEFIVPSVPKFPK | 18 |
| 2 | SEEIEFIVPSVPKFP | 14 |
| 1 | MSEEIEFIVPSVPKF | 12 |
| 14 | KFPKEKIDPLEVEEG | 12 |
| 4 | EIEFIVPSVPKFPKE | 10 |
| | V2-(SET2)-HLA-0401-15mers-282P1G3 Each peptide is a portion of SEQ ID NO: 5; each start position is specified, the length of peptide is 15 amino acids, and the end position for each peptide is the start position plus fourteen. | |
| 2 | WNKIGGDLPKGREAK | 14 |

TABLE XLVIII-continued

| Pos | 123456789012345 | score |
|---|---|---|
| 11 | KGREAKENYGKTLKI | 12 |
| 14 | EAKENYGKTLKIENV | 12 |
| 6 | GGDLPKGREAKENYG | 8 |
| 5 | IGGDLPKGREAKENY | 7 |
| 10 | PKGREAKENYGKTLK | 7 |
| 3 | NKIGGDLPKGREAKE | 6 |
| 4 | KIGGDLPKGREAKEN | 6 |
| 8 | DLPKGREAKENYGKT | 6 |
| 9 | LPKGREAKENYGKTL | 6 |
| 12 | GREAKENYGKTLKIE | 6 |
| 13 | REAKENYGKTLKIEN | 6 |
| | V2-(SET3)-HLA-0401-15mers-282P1G3 Each peptide is a portion of SEQ ID NO: 5; each start position is specified, the length of peptide is 15 amino acids, and the end position for each peptide is the start position plus fourteen. | |
| 13 | EGKYAGLYDDISTQG | 22 |
| 1 | GKPITEESSTLGEGK | 20 |
| 8 | SSTLGEGKYAGLYDD | 14 |
| 15 | KYAGLYDDISTQGWF | 12 |
| | V3-HLA-0401-15mers-282P1G3 Each peptide is a portion of SEQ ID NO: 7; each start position is specified, the length of peptide is 15 amino acids, and the end position for each peptide is the start position plus fourteen. | |
| 8 | IHGVDVINTTYVSNT | 26 |
| 15 | NTTYVSNTTYVSNAT | 22 |
| 5 | APVIHGVDVINTTYV | 20 |
| 22 | TTYVSNATGSPQPSI | 20 |
| 49 | NRNMLAEDFIQKSTS | 20 |
| 50 | RNMLAEDFIQKSTSC | 20 |
| 32 | PQPSIFICSKEQELS | 18 |
| 38 | ICSKEQELSYRNRNM | 18 |
| 51 | NMLAEDFIQKSTSCN | 18 |
| 54 | AEDFIQKSTSCNYVE | 17 |
| 21 | NTTYVSNATGSPQPS | 16 |
| 34 | PSIFICSKEQELSYR | 16 |
| 35 | SIFICSKEQELSYRN | 15 |
| 42 | EQELSYRNRNMLAED | 15 |
| 4 | TAPVIHGVDVINTTY | 14 |
| 10 | GVDVINTTYVSNTTY | 14 |
| 11 | VDVINTTYVSNTTYV | 14 |
| 16 | TTYVSNTTYVSNATG | 14 |
| 55 | EDFIQKSTSCNYVEK | 14 |
| 1 | YPDTAPVIHGVDVIN | 12 |
| 2 | PDTAPVIHGVDVINT | 12 |
| 6 | PVIHGVDVINTTYVS | 12 |
| 7 | VIHGVDVINTTYVSN | 12 |
| 9 | HGVDVINTTYVSNTT | 12 |
| 12 | DVINTTYVSNTTYVS | 12 |
| 13 | VINTTYVSNTTYVSN | 12 |
| 14 | INTTYVSNTTYVSNA | 12 |
| 18 | YVSNTTYVSNATGSP | 12 |
| 19 | VSNTTYVSNATGSPQ | 12 |
| 25 | VSNATGSPQPSIFIC | 12 |
| 27 | NATGSPQPSIFICSK | 12 |
| 30 | GSPQPSIFICSKEQE | 12 |
| 40 | SKEQELSYRNRNMLA | 12 |
| 41 | KEQELSYRNRNMLAE | 12 |
| 43 | QELSYRNRNMLAEDF | 12 |
| 47 | YRNRNMLAEDFIQKS | 12 |
| 48 | RNRNMLAEDFIQKST | 12 |
| 52 | MLAEDFIQKSTSCNY | 12 |
| 61 | STSCNYVEKSSTFFK | 12 |
| 62 | TSCNYVEKSSTFFKI | 12 |
| | V4-HLA-0401-15mers-282P1G3 Each peptide is a portion of SEQ ID NO: 9; each start position is specified, the length of peptide is 15 amino acids, and the end position for each peptide is the start position plus fourteen. | |
| 7 | VTLYSGEDLPEQPTF | 22 |
| 12 | GEDLPEQPTFLKVIK | 20 |
| 4 | PQSVTLYSGEDLPEQ | 14 |
| 3 | DPQSVTLYSGEDLPE | 12 |
| 9 | LYSGEDLPEQPTFLK | 12 |
| 11 | SGEDLPEQPTFLKVI | 12 |
| 15 | LPEQPTFLKVIKVDK | 12 |
| | V5-HLA-0401-15mers-282P1G3 Each peptide is a portion of SEQ ID NO: 11; each start position is specified, the length of peptide is 15 amino acids, and the end position for each peptide is the start position plus fourteen. | |
| 5 | KMPMKLTVNSSNSIK | 20 |
| 7 | PMKLTVNSSNSIKQR | 20 |
| 9 | KLTVNSSNSIKQRKP | 20 |
| 6 | MPMKLTVNSSNSIKQ | 18 |
| 3 | VQKMPMKLTVNSSNS | 15 |
| 4 | QKMPMKLTVNSSNSI | 12 |
| 8 | MKLTVNSSNSIKQRK | 12 |
| 12 | VNSSNSIKQRKPKLL | 12 |
| 15 | SNSIKQRKPKLLLPP | 9 |
| | V6-HLA-0401-15mers-282P1G3 Each peptide is a portion of SEQ ID NO: 13; each start position is specified, the length of peptide is 15 amino acids, and the end position for each peptide is the start position plus fourteen. | |
| 10 | EFIVPKLEHIEQDER | 26 |
| 2 | GIAMSEEIEFIVPKL | 20 |
| 13 | VPKLEHIEQDERVYM | 20 |
| 8 | EIEFIVPKLEHIEQD | 16 |
| 6 | SEEIEFIVPKLEHIE | 14 |
| 1 | LGIAMSEEIEFIVPK | 12 |
| 4 | AMSEEIEFIVPKLEH | 12 |
| 5 | MSEEIEFIVPKLEHI | 12 |
| 14 | PKLEHIEQDERVYMS | 12 |
| | V7-HLA-0401-15mers-282P1G3 Each peptide is a portion of SEQ ID NO: 15; each start position is specified, the length of peptide is 15 amino acids, and the end position for each peptide is the start position plus fourteen. | |
| 6 | THDFHVIVEDNISHE | 22 |
| 8 | DFHVIVEDNISHELF | 20 |
| 10 | HVIVEDNISHELFTL | 20 |
| 21 | LFTLHPEPPRWTKKP | 20 |
| 2 | LGTATHDFHVIVEDN | 18 |
| 9 | FHVIVEDNISHELFT | 14 |
| 14 | EDNISHELFTLHPEP | 14 |
| 18 | SHELFTLHPEPPERWT | 14 |
| 5 | ATHDFHVIVEDNISH | 12 |
| 7 | HDFHVIVEDNISHEL | 12 |
| 11 | VIVEDNISHELFTLH | 12 |
| 15 | DNISHELFTLHPEPP | 12 |
| 22 | FTLHPEPPRWTKKPQ | 12 |
| 19 | HELFTLHPEPPRWTK | 10 |

TABLE XLIX

V1-HLA-DRB1-1101-15mers-282P1G3
Each peptide is a portion of SEQ ID NO: 3; each start position is specified, the length of peptide is 15 amino acids, and the end position for each peptide is the start position plus fourteen.

| Pos | 123456789012345 | score |
|---|---|---|
| 672 | PGRWEELTRVQGKKT | 30 |
| 1113 | LLTVCFVKRNRGGKY | 28 |
| 74 | NPFYFTDHRIIPSNN | 26 |
| 702 | VIAVNEVGRSQPSQP | 26 |
| 843 | KVTWSTVPKDRVHGR | 26 |
| 937 | FLKVIKVDKDTATLS | 26 |
| 1058 | EHIVRLMTKNWGDND | 26 |
| 336 | THDFHVIVEEPPRWT | 25 |
| 760 | GLEYRVTWKPQGAPV | 25 |
| 100 | ISHFQGKYRCFASNK | 24 |
| 446 | GENYATVVGYSAFLH | 24 |
| 934 | QPTFLKVIKVDKDTA | 24 |
| 949 | TLSWGLPKKLNGNLT | 24 |
| 1072 | DSIFQDVIETRGREY | 24 |
| 13 | YLMFLLLKFSKAIEI | 23 |
| 287 | QVDWNKIGGDLPKGR | 23 |
| 470 | VVSWQKVEEVKPLEG | 23 |
| 1083 | GREYAGLYDDISTQG | 23 |
| 1096 | QGWFIGLMCAIALLT | 23 |
| 187 | DLYFANVEEKDSRND | 22 |
| 12 | VYLMFLLLKFSKAIE | 21 |
| 120 | SEEIEFIVPSVPKLP | 21 |
| 127 | VPSVPKLPKEKIDPL | 21 |
| 619 | ITQVTVLDVPDPPEN | 21 |
| 693 | APFVRYQFRVIAVNE | 21 |
| 1025 | SSTLGEGSKGIGKIS | 21 |
| 31 | VQQVPTIIKQSKVQV | 20 |
| 52 | YFQIECEAKGNPEPT | 20 |
| 73 | GNPFYFTDHRIIPSN | 20 |
| 94 | IPNEGHISHFQGKYR | 20 |
| 124 | EFIVPSVPKLPKEKI | 20 |
| 202 | YCCFAAFPRLRTIVQ | 20 |
| 208 | FPRLRTIVQKMPMKL | 20 |
| 221 | KLTVNSLKHANDSSS | 20 |
| 547 | MLELHCESKCDSHLK | 20 |
| 739 | SQPKEMIIKWEPLKS | 20 |
| 877 | HPKEVNILRFSGQRN | 20 |
| 906 | LTVLAYNSKGAGPES | 20 |
| 1029 | GEGSKGIGKISGVNL | 20 |
| 1038 | ISGVNLTQKTHPIEV | 20 |
| 1076 | QDVIETRGREYAGLY | 20 |
| 1161 | KGSLRSLNRDMQPTE | 20 |
| 1124 | GGKYSVKEKEDLHPD | 19 |
| 1180 | LVEYGEGDHGLFSED | 19 |
| 11 | IVYLMFLLLKFSKAI | 18 |
| 75 | PFYFTDHRIIPSNNS | 18 |
| 135 | KEKIDPLEVEEGDPI | 18 |
| 304 | KENYGKTLKIENVSY | 18 |
| 401 | EISFTNLQPNHTAVY | 18 |
| 452 | VVGYSAFLHCEFFAS | 18 |
| 473 | WQKVEEVKPLEGRRY | 18 |
| 602 | QGIYCCSAHTALDSA | 18 |
| 748 | WEPLKSMEQNGPGLE | 18 |
| 798 | DVKVQAINQLGSGPD | 18 |
| 828 | APVIHGVDVINSTLV | 18 |
| 978 | IGELNDINITTPSKP | 18 |
| 1002 | TTKYKFYLRACTSQG | 18 |
| 1115 | TVCFVKRNRGGKYSV | 18 |
| 49 | FDEYFQIECEAKGNP | 17 |
| 50 | DEYFQIECEAKGNPE | 17 |
| 107 | YRCFASNKLGIAMSE | 17 |
| 205 | FAAFPRLRTIVQKMP | 17 |
| 461 | CEFFASPEAVVSWQK | 17 |
| 697 | RYQFRVIAVNEVGRS | 17 |
| 1040 | GVNLTQKTHPIEVFE | 17 |
| 1188 | HGLFSEDGSFIGAYA | 17 |
| 18 | LLKFSKAIEIPSSVQ | 16 |
| 64 | EPTFSWTKDGNPFYF | 16 |

TABLE XLIX-continued

| Pos | 123456789012345 | score |
|---|---|---|
| 163 | HIYWMNIELEHIEQD | 16 |
| 209 | PRLRTIVQKMPMKLT | 16 |
| 291 | NKIGGDLPKGRETKE | 16 |
| 373 | EPQPTIKWRVNGSPV | 16 |
| 392 | FAGDVVFPREISFTN | 16 |
| 428 | ANANIDVVDVRPLIQ | 16 |
| 455 | YSAFLHCEFFASPEA | 16 |
| 524 | NLDIRNATKLRVSPK | 16 |
| 572 | GEAFEINGTEDGRII | 16 |
| 645 | RLTWEAGADHNSNIS | 16 |
| 662 | IVEFEGNKEEPGRWE | 16 |
| 689 | ILPLAPFVRYQFRVI | 16 |
| 745 | IIKWEPLKSMEQNGP | 16 |
| 792 | AVYAPYDVKVQAINQ | 16 |
| 835 | DVINSTLVKVTWSTV | 16 |
| 849 | VPKDRVHGRLKGYQI | 16 |
| 863 | INWWKTKSLLDGRTH | 16 |
| 966 | LLQYQIINDTYEIGE | 16 |
| 983 | DINITTPSKPSWHLS | 16 |
| 1005 | YKFYLRACTSQGCGK | 16 |
| 1054 | EPGAEHIVRLMTKNW | 16 |
| 1087 | AGLYDDISTQGWFIG | 16 |
| 1198 | IGAYAGSKEKGSVES | 16 |
| 15 | MFLLLKFSKAIEIPS | 15 |
| 24 | AIEIPSSVQQVPTII | 15 |
| 123 | IEFIVPSVPKLPKEK | 15 |
| 149 | IVLPCNPPKGLPPLH | 15 |
| 219 | PMKLTVNSLKHANDS | 15 |
| 263 | ESSITILKGEILLLE | 15 |
| 382 | VNGSPVDNHPFAGDV | 15 |
| 476 | VEEVKPLEGRRYHIY | 15 |
| 530 | ATKLRVSPKNPRIPK | 15 |
| 554 | SKCDSHLKHSLKLSW | 15 |
| 661 | YIVEFEGNKEEPGRW | 15 |
| 675 | WEELTRVQGKKTTVI | 15 |
| 682 | QGKKTTVILPLAPFV | 15 |
| 683 | GKKTTVILPLAPFVR | 15 |
| 700 | FRVIAVNEVGRSQPS | 15 |
| 758 | GPGLEYRVTWKPQGA | 15 |
| 824 | YPDTAPVIHGVDVIN | 15 |
| 859 | KGYQINWWKTKSLLD | 15 |
| 869 | KSLLDGRTHPKEVNI | 15 |
| 882 | NILRFSGQRNSGMVP | 15 |
| 903 | EFHLTVLAYNSKGAG | 15 |
| 948 | ATLSWGLPKKLNGNL | 15 |
| 996 | LSNLNATTKYKFYLR | 15 |
| 1018 | GKPITEESSTLGEGS | 15 |
| 1106 | IALLTLLLLTVCFVK | 15 |
| 1157 | EKPLKGSLRSLNRDM | 15 |
| 1197 | FIGAYAGSKEKGSVE | 15 |
| 34 | VPTIIKQSKVQVAFP | 14 |
| 91 | TFRIPNEGHISHFQG | 14 |
| 129 | SVPKLPKEKIDPLEV | 14 |
| 165 | YWMNIELEHIEQDER | 14 |
| 171 | LEHIEQDERVYMSQK | 14 |
| 177 | DERVYMSQKGDLYFA | 14 |
| 186 | GDLYFANVEEKDSRN | 14 |
| 234 | SSSTEIGSKANSIKQ | 14 |
| 240 | GSKANSIKQRKPKLL | 14 |
| 262 | SESSITILKGEILLL | 14 |
| 284 | PTPQVDWNKIGGDLP | 14 |
| 313 | IENVSYQDKGNYRCT | 14 |
| 317 | SYQDKGNYRCTASNF | 14 |
| 329 | SNFLGTATHDFHVIV | 14 |
| 340 | HVIVEEPPRWTKKPQ | 14 |
| 344 | EEPPRWTKKPQSAVY | 14 |
| 375 | QPTIKWRVNGSPVDN | 14 |
| 408 | QPNHTAVYQCEASNV | 14 |
| 429 | NANIDVVDVRPLIQT | 14 |
| 467 | PEAVVSWQKVEEVKP | 14 |
| 491 | ENGTLQINRTTEEDA | 14 |
| 510 | CWVENAIGKTAVTAN | 14 |
| 526 | DIRNATKLRVSPKNP | 14 |
| 532 | KLRVSPKNPRIPKLH | 14 |
| 536 | SPKNPRIPKLHMLEL | 14 |
| 543 | PKLHMLELHCESKCD | 14 |
| 557 | DSHLKHSLKLSWSKD | 14 |

TABLE XLIX-continued

| Pos | 123456789012345 | score |
|---|---|---|
| 616 | AADITQVTVLDVPDP | 14 |
| 631 | PENLHLSERQNRSVR | 14 |
| 656 | SNISEYIVEFEGNKE | 14 |
| 712 | QPSQPSDHHETPPAA | 14 |
| 727 | PDRNPQNIRVQASQP | 14 |
| 762 | EYRVTWKPQGAPVEW | 14 |
| 783 | NHTLRVMTPAVYAPY | 14 |
| 794 | YAPYDVKVQAINQLG | 14 |
| 831 | IHGVDVINSTLVKVT | 14 |
| 836 | VINSTLVKVTWSTVP | 14 |
| 839 | STLVKVTWSTVPKDR | 14 |
| 845 | TWSTVPKDRVHGRLK | 14 |
| 851 | KDRVHGRLKGYQINW | 14 |
| 867 | KTKSLLDGRTHPKEV | 14 |
| 921 | EPYIFQTPEGVPEQP | 14 |
| 935 | PTFLKVIKVDKDTAT | 14 |
| 1128 | SVKEKEDLHPDPEIQ | 14 |
| | V2-(SET2)-HLA-DRB1-1101-15mers-282P1G3 Each peptide is a portion of SEQ ID NO: 5; each start position is specified, the length of peptide is 15 amino acids, and the end position for each peptide is the start position plus fourteen. | |
| 3 | NKIGGDLPKGREAKE | 16 |
| 13 | REAKENYGKTLKIEN | 9 |
| 5 | IGGDLPKGREAKENY | 8 |
| 8 | DLPKGREAKENYGKT | 8 |
| 1 | DWNKIGGDLPKGREA | 7 |
| 4 | KIGGDLPKGREAKEN | 7 |
| 6 | GGDLPKGREAKENYG | 7 |
| | V2-(SET3)-HLA-DRB1-1101-15mers-282P1G3 Each peptide is a portion of SEQ ID NO: 5; each start position is specified, the length of peptide is 15 amino acids, and the end position for each peptide is the start position plus fourteen. | |
| 13 | EGKYAGLYDDISTQG | 23 |
| 1 | GKPITEESSTLGEGK | 15 |
| 7 | ESSTLGEGKYAGLYD | 14 |
| | V3-HLA-DRB1-1101-15mers-282P1G3 Each peptide is a portion of SEQ ID NO: 7; each start position is specified, the length of peptide is 15 amino acids, and the end position for each peptide is the start position plus fourteen. | |
| 52 | MLAEDFIQKSTSCNY | 20 |
| 15 | NTTYVSNTTYVSNAT | 17 |
| 21 | NTTYVSNATGSPQPS | 16 |
| 1 | YPDTAPVIHGVDVIN | 15 |
| 33 | QPSIFICSKEQELSY | 15 |
| 19 | VSNTTYVSNATGSPQ | 14 |
| 42 | EQELSYRNRNMLAED | 14 |
| 61 | STSCNYVEKSSTFFK | 14 |
| 8 | IHGVDVINTTYVSNT | 13 |
| 35 | SIFICSKEQELSYRN | 13 |
| 50 | RNMLAEDFIQKSTSC | 13 |
| 5 | APVIHGVDVINTTYV | 12 |
| 34 | PSIFICSKEQELSYR | 10 |
| 40 | SKEQELSYRNRNMLA | 10 |
| 44 | ELSYRNRNMLAEDFI | 10 |
| 54 | AEDFIQKSTSCNYVE | 10 |
| 4 | TAPVIHGVDVINTTY | 9 |
| | V4-HLA-DRB1-1101-15mers-282P1G3 Each peptide is a portion of SEQ ID NO: 9; each start position is specified, the length of peptide is 15 amino acids, and the end | |

TABLE XLIX-continued

| Pos | 123456789012345 | score |
|---|---|---|
| | position for each peptide is the start position plus fourteen. | |
| 1 | GPDPQSVTLYSGEDL | 12 |
| 7 | VTLYSGEDLPEQPTF | 10 |
| 15 | LPEQPTFLKVIKVDK | 9 |
| 4 | PQSVTLYSGEDLPEQ | 8 |
| 5 | QSVTLYSGEDLPEQP | 7 |
| 12 | GEDLPEQPTFLKVIK | 7 |
| 3 | DPQSVTLYSGEDLPE | 6 |
| 6 | SVTLYSGEDLPEQPT | 6 |
| 8 | TLYSGEDLPEQPTFL | 6 |
| 9 | LYSGEDLPEQPTFLK | 6 |
| | V5-HLA-DRB1-1101-15mers-282P1G3 Each peptide is a portion of SEQ ID NO: 11; each start position is specified, the length of peptide is 15 amino acids, and the end position for each peptide is the start position plus fourteen. | |
| 12 | VNSSNSIKQRKPKLL | 14 |
| 3 | VQKMPMKLTVNSSNS | 12 |
| 4 | QKMPMKLTVNSSNSI | 12 |
| 6 | MPMKLTVNSSNSIKQ | 12 |
| 11 | TVNSSNSIKQRKPKL | 10 |
| 7 | PMKLTVNSSNSIKQR | 9 |
| 14 | SSNSIKQRKPKLLLP | 9 |
| 1 | TIVQKMPMKLTVNSS | 8 |
| 5 | KMPMKLTVNSSNSIK | 8 |
| 13 | NSSNSIKQRKPKLLL | 8 |
| 2 | IVQKMPMKLTVNSSN | 7 |
| 9 | KLTVNSSNSIKQRKP | 7 |
| 15 | SNSIKQRKPKLLLPP | 7 |
| | V6-HLA-DRB1-1101-15mers-282P1G3 Each peptide is a portion of SEQ ID NO: 13; each start position is specified, the length of peptide is 15 amino acids, and the end position for each peptide is the start position plus fourteen. | |
| 10 | EFIVPKLEHIEQDER | 20 |
| 6 | SEEIEFIVPKLEHIE | 15 |
| 7 | EEIEFIVPKLEHIEQ | 15 |
| 3 | IAMSEEIEFIVPKLE | 13 |
| 13 | VPKLEHIEQDERVYM | 12 |
| 8 | EIEFIVPKLEHIEQD | 11 |
| | V7-HLA-DRB1-1101-15mers-282P1G3 Each peptide is a portion of SEQ ID NO: 15; each start position is specified, the length of peptide is 15 amino acids, and the end position for each peptide is the start position plus fourteen. | |
| 6 | THDFHVIVEDNISHE | 19 |
| 18 | SHELFTLHPEPPRWT | 19 |
| 11 | VIVEDNISHELFTLH | 15 |
| 17 | ISHELFTLHPEPPRW | 14 |
| 26 | PEPPRWTKKPQSAVY | 14 |
| 7 | HDFHVIVEDNISHEL | 13 |
| 15 | DNISHELFTLHPEPP | 12 |
| 19 | HELFTLHPEPPRWTK | 12 |
| 2 | LGTATHDFHVIVEDN | 11 |

TABLE L

| Protein Characteristics of 282P1G3 | | | |
|---|---|---|---|
| | Bioinformatic Program | URL | Outcome |
| 282P1G3 v.1 | | | |
| ORF | ORF finder | | |
| Protein length | | | 1224 aa |
| Transmembrane region | TM Pred | http://www.ch.embnet.org/ | 2TM, aa 6–25, 1098–1116 |
| | HMMTop | http://www.enzim.hu/hmmtop/ | one TM, aa 1098–1117 |
| | Sosui | http://www.genome.ad.jp/SOSui/ | 2TM, aa 3–25, 1096–1118 |
| | TMHMM | http://www.cbs.dtu.dk/services/TMHMM | one TM, aa 1097–1119 |
| Signal Peptide | Signal P | http://www.cbs.dtu.dk/services/SignalP/ | y6es, cleave aa 24–25 |
| pI | pI/MW tool | http://www.expasy.ch/tools/ | pI 5.54 |
| Molecular weight | pI/MW tool | http://www.expasy.ch/tools/ | 136.6 kD |
| Localization | PSORT | http://psort.nibb.ac.jp/ | 46% plasma membrane, 10% micobody |
| | PSORT II | http://psort.nibb.ac.jp/ | 44% endoplasmic, 11% vacuolar |
| Motifs | Pfam | http://www.sanger.ac.uk/Pfam/ | Ig domain, Fibronectin type III repeat |
| | Prints | http://www.biochem.ucl.ac.uk/ | Cadherin, Fibronectin type III repeat |
| | Blocks | http://www.blocks.fhere.org/ | Fibronectin type III repeat |
| v.3 | | | |
| ORF | ORF finder | | |
| Protein length | | | 893 aa |
| Transmembrane region | TM Pred | http://www.ch.embnet.org/ | one TM, aa 3–19, N-terminus in |
| | HMMTop | http://www.enzim.hu/hmmtop/ | one TM, aa 1–25, N-terminus out |
| | Sosui | http://www.genome.ad.jp/SOSui/ | one TM, aa 3–25 |
| | TMHMM | http://www.cbs.dtu.dk/services/TMHMM | none |
| Signal Peptide | Signal P | http://www.cbs.dtu.dk/services/SignalP/ | none |
| pI | pI/MW tool | http://www.expasy.ch/tools/ | pI 5.49 |
| Molecular weight | pI/MW tool | http://www.expasy.ch/tools/ | 100.2 kD |
| Localization | PSORT | http://psort.nibb.ac.jp/ | 78% secreted, 19% lysosomal |
| | PSORT II | http://psort.nibb.ac.jp/ | 52% nuclear, 17% mitochondreal |
| Motifs | Pfam | http://www.sanger.ac.uk/Pfam/ | Ig domain, Fibronectin type III repeat |
| | Prints | http://www.biochem.ucl.ac.uk/ | Cadherin, Fibronectin type III repeat |
| | Blocks | http://www.blocks.fhere.org/ | Fibronectin type III repeat |

TABLE LI

| Exon boundaries of transcript 282P1G03 v.1 | | | |
|---|---|---|---|
| Exon Number | Start | End | Length |
| 1 | 1 | 97 | 97 |
| 2 | 98 | 177 | 80 |
| 3 | 178 | 362 | 185 |
| 4 | 363 | 468 | 106 |
| 5 | 469 | 656 | 188 |
| 6 | 657 | 779 | 123 |
| 7 | 780 | 950 | 171 |
| 8 | 951 | 998 | 48 |
| 9 | 999 | 1119 | 121 |
| 10 | 1120 | 1304 | 185 |
| 11 | 1305 | 1436 | 132 |
| 12 | 1437 | 1577 | 141 |
| 13 | 1578 | 1689 | 112 |
| 14 | 1690 | 1906 | 217 |
| 15 | 1907 | 2022 | 116 |
| 16 | 2023 | 2147 | 125 |
| 17 | 2148 | 2249 | 102 |
| 18 | 2250 | 2447 | 198 |
| 19 | 2448 | 2518 | 71 |
| 20 | 2519 | 2741 | 223 |
| 21 | 2742 | 2857 | 116 |
| 22 | 2858 | 3062 | 205 |
| 23 | 3063 | 3185 | 123 |
| 24 | 3186 | 3365 | 180 |
| 25 | 3366 | 3524 | 159 |
| 26 | 3525 | 3656 | 132 |
| 27 | 3657 | 3729 | 73 |
| 28 | 3730 | 7650 | 3921 |

TABLE LIIa

| Nucleotide sequence of transcript variant 282P1G03 v.2 |
|---|
| (SEQ ID NO:151) |
| cggaccctgc gcgcccccgt cccggctccc ggccggctcg ggggagaagg cgcccgaggg 60 |
| gaggcgccgg acagatcgcg tttcggaggc ggcgcaggtg ctgtaaactg caaaccataa 120 |
| tcctgtctta atactgcaaa caaatcatag tggaactaag ggaacttaa tttactgttt 180 |
| ccaggttaac taaggtctca gctgtaaacc aaaagtgaga ggagacatta agattttcat 240 |
| tcttaccggg ttgtcttctt cctgaagagc aatggagccg cttttacttg gaagaggact 300 |
| aatcgtatat ctaatgttcc tcctgttaaa attctcaaaa gcaattgaaa taccatcttc 360 |
| agttcaacag gttccaacaa tcataaaaca gtcaaaagtc caagttgcct ttcccttcga 420 |
| tgagtatttt caaattgaat gtgaagctaa aggaaatcca gaaccaacat tttcgtggac 480 |
| taaggatggc aacccttttt atttcactga ccatcggata attccatcga acaattcagg 540 |
| aacattcagg atcccaaacg aggggcacat atctcacttt caagggaaat accgctgctt 600 |
| tgcttcaaat aaactgggaa tcgctatgtc agaagaaata gaatttatag ttccaagtgt 660 |
| tccaaaattc ccaaaagaaa aaattgaccc tcttgaagtg gaggagggag atccaattgt 720 |
| cctcccatgc aatcctccca aaggcctccc acctttacac atttattgga tgaatattga 780 |
| attagaacac atcgaacaag atgaaagagt atacatgagc caaaagggag atctatactt 840 |
| cgcaaacgtg gaagaaaagg acagtcgcaa tgactactgt tgctttgctg catttccaag 900 |
| attaaggact attgtacaga aaatgccaat gaaactaaca gttaacagtt taaagcatgc 960 |
| taatgactca agttcatcca cagaaattgg ttccaaggca aattccatca agcaaagaaa 1020 |
| acccaaactg ctgttgcctc ccactgagag tggcagtgag tcttcaatta ccatcctcaa 1080 |
| aggggaaatc ttgctgcttg agtgttttgc tgaaggcttg ccaactccac aggttgattg 1140 |
| gaacaaaatt ggtggtgact taccaaaggg gagagaagca aaagaaaatt atggcaagac 1200 |
| tttgaagata gagaatgtct cctaccagga caaaggaaat tatcgctgca cagccagcaa 1260 |
| tttcttggga acagccactc acgattttca cgttatagta gaagagcctc ctcgctggac 1320 |
| aaagaagcct cagagtgctg tgtatagcac cggaagcaat ggcatcttgt tatgtgaggc 1380 |
| tgaaggagaa cctcaaccca caatcaagtg gagagtcaat ggctccccag ttgacaatca 1440 |
| tccatttgct ggtgatgttg tcttccccag ggaaatcagt tttaccaacc ttcaaccaaa 1500 |
| tcatactgct gtgtaccagt gtgaagcctc aaatgtccat ggaactatcc ttgccaatgc 1560 |
| caatattgat gttgtggatg tccgtccatt gatacaaacc aaagatggag aaaattacgc 1620 |
| tacagtggtt gggtacagtg ctttcttaca ttgcgagttc tttgcttcac ctgaggcagt 1680 |
| cgtgtcctgg cagaaggtgg aagaagtgaa acccctggag ggcaggcggt atcatatcta 1740 |
| tgaaaatggc acattgcaga tcaacagaac caccgaagaa gatgctgggt cttactcatg 1800 |
| ttgggtagaa aatgctatag gaaaaactgc agtcacagcc aatttggata ttagaaatgc 1860 |
| tacaaaactt agagtttctc ctaagaatcc tcgtatcccc aaattgcata tgcttgaatt 1920 |
| acattgtgaa agcaaatgtg actcacattt gaaacacagt ttgaagttgt cctggagtaa 1980 |
| agatggagaa gcctttgaaa ttaatggcac agaagatggc aggataatta ttgatggagc 2040 |
| taatttgacc atatctaatg taactttaga ggaccaaggt atttactgct gttcagctca 2100 |
| tactgctcta gacagtgctg ccgatataac tcaagtaact gttcttgatg ttccggatcc 2160 |
| accagaaaac cttcacttgt ctgaaagaca gaacaggagt gttcggctga cctgggaagc 2220 |
| tggagctgac cacaacagca atattagcga gtatattgtt gaatttgaag gaaacaaaga 2280 |

TABLE LIIa-continued

| Nucleotide sequence of transcript variant 282P1G03 v.2 |
|---|
| agagcctgga aggtgggagg aactgaccag agtccaagga aagaaaacca cagttatctt 2340 |
| acctttggct ccatttgtga gataccagtt cagggtcata gccgtgaacg aagtagggag 2400 |
| aagtcagcct agccagccgt cagaccatca tgaaacacca ccagcagctc cagataggaa 2460 |
| tccacaaaac ataagggttc aagcctctca acccaaggaa atgattataa agtgggagcc 2520 |
| tttgaaatcc atggagcaga atggaccagg cctagagtac agagtgacct ggaagccaca 2580 |
| gggagcccca gtggagtggg aagaagaaac agtcacaaac cacacattgc gggtgatgac 2640 |
| gcctgctgtc tatgcccctt atgatgtcaa ggtccaggct atcaatcaac taggatctgg 2700 |
| gcctgaccct cagtcagtga ctctctattc tggagaagac tatcctgata cagctccagt 2760 |
| gatccatggg gtggacgtta taaacagtac attagttaaa gttacctggt caacagttcc 2820 |
| aaaggacaga gtacatggac gtctgaaagg ctatcagata aattggtgga aaacaaaaag 2880 |
| tctgttggat ggaagaacac atcccaaaga agtgaacatt ctaagatttt caggacaaag 2940 |
| aaactctgga atggttcctt ccttagatgc ctttagtgaa tttcatttaa cagtcttagc 3000 |
| ctataactct aaaggagctg gtcctgaaag tgagccttat atatttcaaa caccagaagg 3060 |
| agtacctgaa cagccaactt ttctaaaggt catcaaagtt gataaagaca ctgccacttt 3120 |
| atcttgggga ctacctaaga aattaaatgg aaacttaact ggctatcttt tgcaatatca 3180 |
| gataataaat gacacctacg agattggaga attaaatgat attaacatta caactccatc 3240 |
| aaagcccagc tggcacctct caaacctgaa tgcaactacc aagtacaaat tctacttgag 3300 |
| ggcttgcact tcacagggct gtggaaaacc gatcacggag gaaagctcca ccttaggaga 3360 |
| agggaaatat gctggtttat atgatgacat ctccactcaa ggctggttta ttggactgat 3420 |
| gtgtgcgatt gctcttctca cactactatt attaactgtt tgctttgtga agaggaatag 3480 |
| aggtggaaag tactcagtta aagaaaagga agatttgcat ccagacccag aaattcagtc 3540 |
| agtaaaagat gaaacctttg gtgaatacag tgacagtgat gaaaagcctc tcaaaggaag 3600 |
| ccttcggtcc cttaataggg atatgcagcc tactgaaagt gctgacagct tagtcgaata 3660 |
| cggagaggga gaccatggtc tcttcagtga agatggatca tttattggtg cctacgctgg 3720 |
| atctaaggag aagggatctg ttgaaagcaa tggaagttct acagcaactt ttccccttcg 3780 |
| ggcataaaca caacatatgt aagcaacgct actggttcac cccaaccttc catatttatc 3840 |
| tgttcaaagg agcaagaact ttcatatagg aatagaaaca tgctggccga agatttcatc 3900 |
| cagaagtcaa catcctgcaa ttatgttgaa aagagtagta ctttcttcaa aatataaaat 3960 |
| gccaagcact tcaggcctat gttttgctta tattgttttc aggtgctcaa aatgcaaaac 4020 |
| acaaaacaaa tcctgcattt agatacacct caactaaatc caaagtcccc attcagtata 4080 |
| ttccatattt gcctgatttt actattcggt gtgtttgcat agatgttgct acttggtggg 4140 |
| tttttctccg tatgcacatt ggtatacagt ctctgagaac tggcttggtg actttgcttc 4200 |
| actacaggtt aaaagaccat aagcaaactg gttatttaaa atgtaaaaag gaatatgaaa 4260 |
| gtcttattaa aacacttcat tgaaaatata cagtctaaat ttattattta aattttacta 4320 |
| gcaaaagtct taggtgaaca atcaactagt atttgttgag ctcctatttg cccagagatg 4380 |
| gtcatattta aacagaagta tacgtttttc agtttcaaca tgaatttttt tatttctgtc 4440 |
| agttatgaca tccacgagca tcactttttg tgtctgtttt tttttttttc ttggactaaa 4500 |
| ttcaactgca tggaagcggt ggtcagaagg ttgttttata cgagaacagg cagaaagtgc 4560 |
| ccattgttca ggattctaat agctacatct acttaatatc ttcatttcta aattgactgc 4620 |

TABLE LIIa-continued

| Nucleotide sequence of transcript variant 282P1G03 v.2 |
|---|
| ttttaccttt ttctcatgtt tatataatgg tatgcttgca tatatttcat gaatacattg 4680 |
| tacatattat gttaatattt acacaattta aaatatagat gtgtttttatt ttgaagtgag 4740 |
| aaaatgaaca ttaacaggca tgtttgtaca gctagaatat attagtaaqa tactgttttt 4800 |
| cgtcattcca gagctacaac taataacacg aggttccaaa gctgaagact ttgtataaag 4860 |
| tatttgggtt ttgttcttgt attgctttct ttcaacagtt tcaaaataaa atatcataca 4920 |
| aatattgagg gaaatgtttt catatttttc aaaataggtt tttattgttg aatgtacatc 4980 |
| taccccagcc cctcaaaaga aaaactgttt acatagaaat tcctacacat acgtttgcgt 5040 |
| atatgttatt ttaaacatct ttgtggtgag aattttttcc ccgatattct ccttctgtca 5100 |
| aagtcagaac aaattcaggg aatttatttt ctggcagttg tgctccagtc cttttaaaat 5160 |
| tgtacatgaa catgttttag aaacaatatg gaggatgatg catacatgtc ggtcaagttc 5220 |
| agcgctcgac attttatgga aagatttttt taaccttacc acgaaatact taactactgt 5280 |
| ttaagtgaat tgacttattt cactttagtt tttgaactgt gattattggt atactgttat 5340 |
| atcctcaact tggatttatg gtaacccctt ttagttcatg gagaccaaaa tttggggtat 5400 |
| ttataatagt cagcgcagga atgcacatgg aatatctact tgtccttttg aacctcacga 5460 |
| gtcatccaga atgtatagac aggaaaagca tgtcttattt aaaactgtaa tttatgggct 5520 |
| caggatctga ccgcagtccc gggagtaagc atttcaaagg gggaaggcag tgtggtccct 5580 |
| accctgtgtg aatgtgagga tgtagacatc catcagtgca actcgagctc catcctcctc 5640 |
| cgatttctaa ggctccagtt ttctggaggg acagtcatca tgttttgatt tatctgggag 5700 |
| aaaactgtgg tgcacagctt gtgaggaggg caaggttgtg acgttcgagc ttagttctgg 5760 |
| tgttattctg tctcctcttc tttgtcatca gccaaaacgt ggtttttaaa gagagtcatg 5820 |
| caggttagaa ataatgtcaa aaatatttag gaatttaata acctttaagt cagaaactaa 5880 |
| aacaaatact gaaatattag ctcttcctac acttcgtgtt ccccttttagc tgcctgaaaa 5940 |
| tcaagattgc tcctactcag atcttctgag tggctaaaac ttatggatat gaaaaatgag 6000 |
| attgaatgat gactatgctt tgctatcatt gttacctttc ctcaatacta tttggcaact 6060 |
| actgggactc ttcagcacaa aaggaataga tctatgattg accctgattt taattgtgaa 6120 |
| attatatgat tcatatattt tatgaatcag aataaccttc aaataaaata aatctaagtc 6180 |
| ggttaaaatg gatttcatga ttttccctca gaaaatgagt aacggagtcc acggcgtgca 6240 |
| atggtaatta taaattggtg atgcttgttt gcaaattgcc cactcgtgat aagtcaacag 6300 |
| ccaatattta aaactttgtt cgttactggc tttaccctaa ctttctctag tctactgtca 6360 |
| atatcatttt aatgtaattg attgtatata gtctcaagaa tggttggtgg gcatgagttc 6420 |
| ctagagaact gtccaagggt tgggaaaatc caaattctct tcctggctcc agcactgatt 6480 |
| ttgtacataa acattaggca ggttgcttaa cctttttatt tcaaactctc tcaactctaa 6540 |
| agtgctaata ataatctcag ttaccttatc tttgtcacag ggtgttcttt tttatgaaga 6600 |
| aaaatttgaa aatgataaaa gctaagatgc cttctaactt cataagcaaa cctttaacta 6660 |
| attatgtatc tgaaagtcac ccccacatac caactcaact tttttcctgt gaacacataa 6720 |
| atatattttt atagaaaaac aaatctacat aaaataaatc tactgtttag tgagcagtat 6780 |
| gacttgtaca tgccattgaa aattattaat cagaagaaaa ttaagcaggg tctttgctat 6840 |
| acaaaagtgt tttccactaa ttttgcatgc gtatttataa gaaaaatgtg aatttggtgg 6900 |

TABLE LIIa-continued

| Nucleotide sequence of transcript variant 282P1G03 v.2 | |
|---|---|
| ttttattcta tcggtataaa ggcatcgata ttttagatgc acccgtgttt gtaaaaatgt | 6960 |
| agagcacaat ggaattatgc tggaagtctc aaataatatt tttttcctat tttatactca | 7020 |
| tggaagagat aagctaaaga ggggacaata atgagaaatg ttggtgtgct tttctaagca | 7080 |
| tttaaaacat aattgccaat tgaaacccta aatatgttta cataccatta agatatgatt | 7140 |
| catgtaacaa tgttaaatta attataatgg gattgggttt gttatctgtg gtagtatata | 7200 |
| tcctagtgtt cctatagtga aataagtagg gttcagccaa agctttcttt gttttgtacc | 7260 |
| ttaaattgtt cgattacgtc atcaaaagag atgaaaggta tgtagaacag gttcacgtga | 7320 |
| ttaccttttt cttttggctt ggattaatat tcatagtaga actttataaa acgtgtttgt | 7380 |
| attgtaggtg gtgtttgtat tatgcttatg actatgtatg gtttgaaaat atttcatta | 7440 |
| tacatgaaat tcaactttcc aaataaaagt tctacttcat gtaatccaaa a | 7491 |

TABLE LIIIa

Nucleotide sequence alignment of 282P1G03 v.1 (SEQ ID NO: 152) and 282P1G03 v.2 (SEQ ID NO: 153)

```
v.1    1  cggaccctgcgcgcccccgtcccggctcccggccggctcgggggagaagg  50
          ||||||||||||||||||||||||||||||||||||||||||||||||||
v.2    1  CGGACCCTGCCCGCCCCCGTCCCGGCTCCCGGCCGGCTCGGGGGAGAAGG  50

v.1   51  cgcccgagggggaggcgccggacagatcgcgtttcggaggcggcgcaggtg  100
          ||||||||||||||||||||||||||||||||||||||||||||||||||
v.2   51  CGCCCGAGGGGAGGCGCCGGACAGATCGCGTTTCGGAGGCGGCCCAGGTG  100

v.1  101  ctgtaaactgcaaaccataatcctgtcttaatactgcaaacaaatcatag  150
          ||||||||||||||||||||||||||||||||||||||||||||||||||
v.2  101  CTGTAAACTGCAAACCATAATCCTGTCTTAATACTGCAAACAAATCATAG  150

v.1  151  tggaactaaggggaacttaatttactgtttccaggttaactaaggtctca  200
          ||||||||||||||||||||||||||||||||||||||||||||||||||
v.2  151  TGGAACTAAGGGGAACTTAATTTACTGTTTCCAGGTTAACTAAGGTCTCA  200

v.1  201  gctgtaaaccaaaagtgagaggagacattaagattttcattcttaccggg  250
          ||||||||||||||||||||||||||||||||||||||||||||||||||
v.2  201  GCTGTAAACCAAAAGTGAGAGGAGACATTAAGATTTTCATTCTTACCGGG  250

v.1  251  ttgtcttcttcctgaagagcaatggagccgcttttacttggaagaggact  300
          ||||||||||||||||||||||||||||||||||||||||||||||||||
v.2  251  TTGTCTTCTTCCTGAAGAGCAATGGAGCCGCTTTTACTTGGAAGAGGACT  300

v.1  301  aatcgtatatctaatgttcctcctgttaaaattctcaaaagcaattgaaa  350
          ||||||||||||||||||||||||||||||||||||||||||||||||||
v.2  301  AATCGTATATCTAATGTTCCTCCTGTTAAAATTCTCAAAAGCAATTGAAA  350

v.1  351  taccatcttcagttcaacaggttccaacaatcataaaacagtcaaaagtc  400
          ||||||||||||||||||||||||||||||||||||||||||||||||||
v.2  351  TACCATCTTCAGTTCAACAGGTTCCAACAATCATAAAACAGTCAAAAGTC  400

v.1  401  caagttgcctttcccttcgatgagtattttcaaattgaatgtgaagctaa  450
          ||||||||||||||||||||||||||||||||||||||||||||||||||
v.2  401  CAAGTTGCCTTTCCCTTCGATGAGTATTTTCAAATTGAATGTGAAGCTAA  450

v.1  451  aggaaatccagaaccaacattttcgtggactaaggatggcaacccttttt  500
          ||||||||||||||||||||||||||||||||||||||||||||||||||
v.2  451  AGGAAATCCAGAACCAACATTTTCGTGGACTAAGGATGGCAACCCTTTTT  500

v.1  501  atttcactgaccatcggataattccatcgaacaattcaggaacattcagg  550
          ||||||||||||||||||||||||||||||||||||||||||||||||||
v.2  501  ATTTCACTGACCATCGGATAATTCCATCGAACAATTCAGGAACATTCAGG  550

v.1  551  atcccaaacgaggggcacatatctcactttcaagggaaataccgctgctt  600
          ||||||||||||||||||||||||||||||||||||||||||||||||||
v.2  551  ATCCCAAACGAGGGGCACATATCTCACTTTCAAGGGAAATACCGCTGCTT  600

v.1  601  tgcttcaaataaactgggaatcgctatgtcagaagaaatagaatttatag  650
```

TABLE LIIIa-continued

Nucleotide sequence alignment of 282P1G03 v.1 (SEQ ID NO: 152) and 282P1G03 v.2 (SEQ ID NO: 153)

```
                ||||||||||||||||||||||||||||||||||||||||||||||||||
v.2    601  TGCTTCAAATAAACTGGGAATCGCTATGTCAGAAGAAATAGAATTTATAG  650

v.1    651  ttccaagtgttccaaaactcccaaaagaaaaaattgaccctcttgaagtg  700
            ||||||||||||||||||||||||||||||||||||||||||||||||||
v.2    651  TTCCAAGTGTTCCAAAATTCCCAAAAGAAAAAATTGACCCTCTTGAAGTG  700

v.1    701  gaggagggagatccaattgtcctcccatgcaatcctcccaaaggcctccc  750
            ||||||||||||||||||||||||||||||||||||||||||||||||||
v.2    701  GAGGAGGGAGATCCAATTGTCCTCCCATGCAATCCTCCCAAAGGCCTCCC  750

v.1    751  acctttacacatttattggatgaatattgaattagaacacatcgaacaag  800
            ||||||||||||||||||||||||||||||||||||||||||||||||||
v.2    751  ACCTTTACACATTTATTGGATGAATATTGAATTAGAACACATCGAACAAG  800

v.1    801  atgaaagagtatacatgaqccaaaagggagatctatacttcgcaaacgtg  850
            ||||||||||||||||||||||||||||||||||||||||||||||||||
v.2    801  ATGAAAGAGTATACATGAGCCAAAAGGGAGATCTATACTTCGCAAACGTG  850

v.1    851  gaagaaaaggacagtcgcaatgactactgttgctttgctgcatttccaag  900
            ||||||||||||||||||||||||||||||||||||||||||||||||||
v.2    851  GAAGAAAAGGACAGTCGCAATGACTACTGTTGCTTTGCTGCATTTCCAAG  900

v.1    901  attaaggactattgtacagaaaatgccaatgaaactaacagttaacagtt  950
            ||||||||||||||||||||||||||||||||||||||||||||||||||
v.2    901  ATTAAGGACTATTGTACAGAAAATGCCAATGAAACTAACAGTTAACAGTT  950

v.1    951  taaagcatgctaatgactcaagttcatccacagaaattggttccaaggca  1000
            ||||||||||||||||||||||||||||||||||||||||||||||||||
v.2    951  TAAAGCATGCTAATGACTCAAGTTCATCCACAGAAATTGGTTCCAAGGCA  1000

v.1   1001  aattccatcaagcaaagaaaacccaaactgctgttgcctcccactgagag  1050
            ||||||||||||||||||||||||||||||||||||||||||||||||||
v.2   1001  AATTCCATCAAGCAAAGAAAACCCAAACTGCTGTTGCCTCCCACTGAGAG  1050

v.1   1051  tggcagtgagtcttcaattaocatcctcaaaggggaaatcttgctgcttg  1100
            ||||||||||||||||||||||||||||||||||||||||||||||||||
v.2   1051  TGGCAGTGAGTCTTCAATTACCATCCTCAAAGGGGAAATCTTGCTGCTTG  1100

v.1   1101  agtgttttgctgaaggcttgccaactccacaggttgattggaacaaaatt  1150
            ||||||||||||||||||||||||||||||||||||||||||||||||||
v.2   1101  AGTGTTTTGCTGAAGGCTTGCCAACTCCACAGGTTGATTGGAACAAAATT  1150

v.1   1151  ggtggtgacttaccaaaggggagagaaacaaaagaaaattatggcaagac  1200
            ||||||||||||||||||||||||||||||||||||||||||||||||||
v.2   1151  GGTGGTGACTTACCAAAGGGGAGAGAAgCAAAAGAAAATTATGGCAAGAC  1200

v.1   1201  tttgaagatagagaatgtctcctaccaggacaaaggaaattatcgctgca  1250
            ||||||||||||||||||||||||||||||||||||||||||||||||||
v.2   1201  TTTGAAGATAGAGAATGTCTCCTACCAGGACAAAGGAAATTATCGCTGCA  1250

v.1   1251  cagccagcaatttcttgggaacagccactcacgattttcacgttatagta  1300
            ||||||||||||||||||||||||||||||||||||||||||||||||||
v.2   1251  CAGCCAGCAATTTCTTGGGAACAGCCACTCACGATTTTCACGTTATAGTA  1300

v.1   1301  gaagagcctcctcgctggacaaagaagcctcagagtgctgtgtatagcac  1350
            ||||||||||||||||||||||||||||||||||||||||||||||||||
v.2   1301  GAAGAGCCTCCTCGCTGGACAAAGAAGCCTCAGAGTGCTGTGTATAGCAC  1350

v.1   1351  cggaagcaatggcatcttgttatgtgaggctgaaggagaacctcaaccca  1400
            ||||||||||||||||||||||||||||||||||||||||||||||||||
v.2   1351  CGGAAGCAATGGCATCTTGTTATGTGAGGCTGAAGGAGAACCTCAACCCA  1400

v.1   1401  caatcaagtggagagtcaatggctccccagttgacaatcatccatttgct  1450
            ||||||||||||||||||||||||||||||||||||||||||||||||||
v.2   1401  CAATCAAGTGGAGAGTCAATGCCTCCCCAGTTGACAATCATCCATTTGCT  1450

v.1   1451  ggtgatgttgtcttccccagggaaatcagttttaccaaccttcaaccaaa  1500
            ||||||||||||||||||||||||||||||||||||||||||||||||||
v.2   1451  GGTGATGTTGTCTTCCCCAGGGAAATCAGTTTTACCAACCTTCAACCAAA  1500

v.1   1501  tcatactgctgtgtaccagtgtgaagcctcaaatgtccatggaactatcc  1550
            ||||||||||||||||||||||||||||||||||||||||||||||||||
v.2   1501  TCATACTGCTGTGTACCAGTGTGAAGCCTCAAATGTCCATGGAACTATCC  1550

v.1   1551  ttgccaatgccaatattgatgttgtggatgtccgtccattgatacaaacc  1600
```

TABLE LIIIa-continued

Nucleotide sequence alignment of 282P1G03 v.1 (SEQ ID NO: 152) and 282P1G03 v.2 (SEQ ID NO: 153)

```
               ||||||||||||||||||||||||||||||||||||||||||||||||||
v.2  1551  TTGCCAATGCCAATATTGATGTTGTGGATGTCCGTCCATTGATACAAACC  1600

v.1  1601  aaagatggagaaaattacgctacagtggttgggtacagtgctttcttaca  1650
           ||||||||||||||||||||||||||||||||||||||||||||||||||
v.2  1601  AAAGATGGAGAAAATTACGCTACAGTGGTTGGGTACAGTGCTTTCTTACA  1650

v.1  1651  ttgcgagttctttgcttcacctgaggcagtcgtgtcctggcagaaggtgg  1700
           ||||||||||||||||||||||||||||||||||||||||||||||||||
v.2  1651  TTGCGAGTTCTTTGCTTCACCTGAGGCAGTCGTGTCCTGGCAGAAGGTGG  1700

v.1  1701  aagaagtgaaacccctggagggcaggcggtatcatatctatgaaaatggc  1750
           ||||||||||||||||||||||||||||||||||||||||||||||||||
v.2  1701  AAGAAGTGAAACCCCTGGAGGGCAGGCGGTATCATATCTATGAAAATGGC  1750

v.1  1751  acattgcagatcaacagaaccaccgaagaagatgctgggtcttactcatg  1800
           ||||||||||||||||||||||||||||||||||||||||||||||||||
v.2  1751  ACATTGCAGATCAACAGAACCACCGAAGAAGATGCTGGGTCTTACTCATG  1800

v.1  1801  ttgggtagaaaatgctataggaaaaactgcagtcacagccaatttggata  1850
           ||||||||||||||||||||||||||||||||||||||||||||||||||
v.2  1801  TTGGGTAGAAAATGCTATAGGAAAAACTGCAGTCACAGCCAATTTGGATA  1850

v.1  1851  ttagaaatgctacaaaacttagagtttctcctaagaatcctcgtatcccc  1900
           ||||||||||||||||||||||||||||||||||||||||||||||||||
v.2  1851  TTAGAAATGCTACAAAACTTAGAGTTTCTCCTAAGAATCCTCGTATCCCC  1900

v.1  1901  aaattgcatatgcttgaattacattgtgaaagcaaatgtgactcacattt  1950
           ||||||||||||||||||||||||||||||||||||||||||||||||||
v.2  1901  AAATTGCATATGCTTGAATTACATTGTGAAAGCAAATGTGACTCACATTT  1950

v.1  1951  gaaacacagtttgaagttgtcctggagtaaagatggagaagcctttgaaa  2000
           ||||||||||||||||||||||||||||||||||||||||||||||||||
v.2  1951  GAAACACAGTTTGAAGTTGTCCTGGAGTAAAGATGGAGAAGCCTTTGAAA  2000

v.1  2001  ttaatggcacagaagatggcaggataattattgatqgaqctaatttgacc  2050
           ||||||||||||||||||||||||||||||||||||||||||||||||||
v.2  2001  TTAATGGCACAGAAGATGGCAGGATAATTATTGATGGAGCTAATTTGACC  2050

v.1  2051  atatctaatgtaactttagaggaccaaggtatttactgctgttcagctca  2100
           ||||||||||||||||||||||||||||||||||||||||||||||||||
v.2  2051  ATATCTAATGTAACTTTAGAGGACCAAGGTATTTACTGCTGTTCAGCTCA  2100

v.1  2101  tactgctctagacagtgctgccgatataactcaagtaactgttcttgatg  2150
           ||||||||||||||||||||||||||||||||||||||||||||||||||
v.2  2101  TACTGCTCTAGACAGTGCTGCCGATATAACTCAAGTAACTGTTCTTGATG  2150

v.1  2151  ttccggatccaccagaaaaccttcacttgtctgaaagacagaacaggagt  2200
           ||||||||||||||||||||||||||||||||||||||||||||||||||
v.2  2151  TTCCGGATCCACCAGAAAACCTTCACTTGTCTGAAAGACAGAACAGGAGT  2200

v.1  2201  gttcggctgacctgggaagctggagctgaccacaacagcaatattagcga  2250
           ||||||||||||||||||||||||||||||||||||||||||||||||||
v.2  2201  GTTCGGCTGACCTGGGAAGCTGGAGCTGACCACAACAGCAATATTAGCGA  2250

v.1  2251  gtatattgttgaatttgaaggaaacaaagaagagcctggaaggtgggagg  2300
           ||||||||||||||||||||||||||||||||||||||||||||||||||
v.2  2251  GTATATTGTTGAATTTGAAGGAAACAAAGAAGAGCCTGGAAGGTGGGAGG  2300

v.1  2301  aactgaccagagtccaaggaaagaaaaccacagttatcttacctttggct  2350
           ||||||||||||||||||||||||||||||||||||||||||||||||||
v.2  2301  AACTCACCAGAGTCCAAGGAAAGAAAACCACAGTTATCTTACCTTTGGCT  2350

v.1  2351  ccatttgtgagataccagttcagggtcatagccgtgaacgaagtagggag  2400
           ||||||||||||||||||||||||||||||||||||||||||||||||||
v.2  2351  CCATTTGTGAGATACCAGTTCAGGGTCATAGCCGTGAACGAAGTAGGGAG  2400

v.1  2401  aagtcagcctagccagccgtcagaccatcatgaaacaccaccagcagctc  2450
           ||||||||||||||||||||||||||||||||||||||||||||||||||
v.2  2401  AAGTCAGCCTAGCCAGCCGTCAGACCATCATGAAACACCACCAGCAGCTC  2450

v.1  2451  cagataggaatccacaaaacataagggttcaagcctctcaacccaaggaa  2500
           ||||||||||||||||||||||||||||||||||||||||||||||||||
v.2  2451  CAGATAGGAATCCACAAAACATAAGGGTTCAAGCCTCTCAACCCAAGGAA  2500

v.1  2501  atgattataaagtgggagcctttgaaatccatggagcagaatggaccagg  2550
```

TABLE LIIIa-continued

Nucleotide sequence alignment of 282P1G03 v.1 (SEQ ID NO: 152) and 282P1G03 v.2 (SEQ ID NO: 153)

```
                 ||||||||||||||||||||||||||||||||||||||||||||||||||
v.2  2501  ATGATTATAAAGTGGGAGCCTTTGAAATCCATGGAGCAGAATGGACCAGG  2550

v.1  2551  cctagagtacagagtgacctggaagccacagggagccccagtggagtggg  2600
           ||||||||||||||||||||||||||||||||||||||||||||||||||
v.2  2551  CCTAGAGTACAGAGTGACCTGGAAGCCACAGGGAGCCCCAGTGGAGTGGG  2600

v.1  2601  aagaagaaacagtcacaaaccacacattgcgggtgatgacgcctgctgtc  2650
           ||||||||||||||||||||||||||||||||||||||||||||||||||
v.2  2601  AAGAAGAAACAGTCACAAACCACACATTGCGGGTGATGACGCCTGCTGTC  2650

v.1  2651  tatgccccttatgatgtcaaggtccaggctatcaatcaactaggatctgg  2700
           ||||||||||||||||||||||||||||||||||||||||||||||||||
v.2  2651  TATGCCCCTTATGATGTCAAGGTCCAGGCTATCAATCAACTAGCATCTGG  2700

v.1  2701  gcctgaccctcagtcagtgactctctattctggagaagactatcctgata  2750
           ||||||||||||||||||||||||||||||||||||||||||||||||||
v.2  2701  GCCTGACCCTCAGTCAGTGACTCTCTATTCTGGAGAAGACTATCCTGATA  2750

v.1  2751  cagctccagtgatccatggggtggacgttataaacagtacattagttaaa  2800
           ||||||||||||||||||||||||||||||||||||||||||||||||||
v.2  2751  CAGCTCCAGTGATCCATGGGGTGGACGTTATAAACAGTACATTAGTTAAA  2800

v.1  2801  gttacctggtcaacagttccaaaggacagagtacatggacgtctgaaagg  2850
           ||||||||||||||||||||||||||||||||||||||||||||||||||
v.2  2801  GTTACCTGGTCAACAGTTCCAAAGGACAGAGTACATGGACGTCTGAAAGG  2850

v.1  2851  ctatcagataaattggtggaaaacaaaaagtctgttggatggaagaacac  2900
           ||||||||||||||||||||||||||||||||||||||||||||||||||
v.2  2851  CTATCAGATAAATTGGTGGAAAACAAAAAGTCTGTTGGATGGAAGAACAC  2900

v.1  2901  atcccaaagaagtgaacattctaagattttcaggacaaagaaactctgga  2950
           ||||||||||||||||||||||||||||||||||||||||||||||||||
v.2  2901  ATCCCAAAGAAGTGAACATTCTAAGATTTTCAGGACAAAGAAACTCTGGA  2950

v.1  2951  atggttccttccttagatgcctttagtgaatttcatttaacagtcttagc  3000
           ||||||||||||||||||||||||||||||||||||||||||||||||||
v.2  2951  ATGGTTCCTTCCTTAGATGCCTTTAGTGAATTTCATTTAACAGTCTTAGC  3000

v.1  3001  ctataactctaaaggagctggtcctgaaagtgagccttatatatttcaaa  3050
           ||||||||||||||||||||||||||||||||||||||||||||||||||
v.2  3001  CTATAACTCTAAAGGAGCTGGTCCTGAAAGTGAGCCTTATATATTTCAAA  3050

v.1  3051  caccagaaggagtacctgaacagccaacttttctaaaggtcatcaaagtt  3100
           ||||||||||||||||||||||||||||||||||||||||||||||||||
v.2  3051  CACCAGAAGGAGTACCTGAACAGCCAACTTTTCTAAAGGTCATCAAAGTT  3100

v.1  3101  gataaagacactgccactttatcttggggactacctaagaaattaaatgg  3150
           ||||||||||||||||||||||||||||||||||||||||||||||||||
v.2  3101  GATAAAGACACTGCCACTTTATCTTGGGGACTACCTAAGAAATTAAATGG  3150

v.1  3151  aaacttaactggctatcttttgcaatatcagataataaatgacacctacg  3200
           ||||||||||||||||||||||||||||||||||||||||||||||||||
v.2  3151  AAACTTAACTGGCTATCTTTTGCAATATCAGATAATAAATGACACCTACG  3200

v.1  3201  agattggagaattaaatgatattaacattacaactccatcaaagcccagc  3250
           ||||||||||||||||||||||||||||||||||||||||||||||||||
v.2  3201  AGATTGGAGAATTAAATGATATTAACATTACAACTCCATCAAAGCCCAGC  3250

v.1  3251  tggcacctctcaaacctgaatgcaactaccaagtacaaattctacttcag  3300
           ||||||||||||||||||||||||||||||||||||||||||||||||||
v.2  3251  TGGCACCTCTCAAACCTGAATGCAACTACCAAGTACAAATTCTACTTGAG  3300

v.1  3301  ggcttgcacttcacagggctgtggaaaaccgatcacggaggaaagctcca  3350
           ||||||||||||||||||||||||||||||||||||||||||||||||||
v.2  3301  GGCTTGCACTTCACAGGGCTGTGGAAAACCGATCACGGAGGAAAGCTCCA  3350

v.1  3351  ccttaggagaagggagtaaaggtatcgggaagatatcaggagtaaatctt  3400
           |||||||||||||||
v.2  3351  CCTTAGGAGAAGGGA-----------------------------------  3365

v.1  3401  actcaaaagactcacccaatagaggtatttgagccgggagctgaacatat  3450

v.2  3366  --------------------------------------------------  3365

v.1  3451  agttcgcctaatgactaagaattggggcgataacgatagcatttttcaag  3500
```

TABLE LIIIa-continued

Nucleotide sequence alignment of 282P1G03 v.1 (SEQ ID NO: 152) and 282P1G03 v.2 (SEQ ID NO: 153)

```
v.2  3366  --------------------------------------------------  3365

v.1  3501  atgtaattgagacaagagggagagaatatgctggtttatatgatgacatc  3550
                                     ||||||||||||||||||||||||||
v.2  3366  ------------------------AATATGCTGGTTTATATGATGACATC  3391

v.1  3551  tccactcaaggctggtttattggactgatgtgtgcgattgctcttctcac  3600
           ||||||||||||||||||||||||||||||||||||||||||||||||||
v.2  3392  TCCACTCAAGGCTGGTTTATTGGACTGATGTGTGCGATTGCTCTTCTCAC  3441

v.1  3601  actactattatttaactgtttgctttgtgaagaggaatagaggtggaaagt 3650
           ||||||||||||||||||||||||||||||||||||||||||||||||||
v.2  3442  ACTACTATTATTAACTGTTTGCTTTGTGAAGAGGAATAGAGGTGGAAAGT  3491

v.1  3651  actcagttaaagaaaaggaagatttgcatccagacccagaaattcagtca  3700
           ||||||||||||||||||||||||||||||||||||||||||||||||||
v.2  3492  ACTCAGTTAAAGAAAAGGAAGATTTGCATCCAGACCCAGAAATTCAGTCA  3541

v.1  3701  gtaaaagatgaaacctttggtgaatacagtgacagtgatgaaaagcctct  3750
           ||||||||||||||||||||||||||||||||||||||||||||||||||
v.2  3542  GTAAAAGATGAAACCTTTGGTGAATACAGTGACAGTGATGAAAAGCCTCT  3591

v.1  3751  caaaggaagccttcggtcccttaatagggatatgcagcctactgaaagtg  3800
           ||||||||||||||||||||||||||||||||||||||||||||||||||
v.2  3592  CAAAGGAAGCCTTCGGTCCCTTAATAGGGATATGCAGCCTACTGAAAGTG  3641

v.1  3801  ctgacagcttagtcgaatacggagagggagaccatggtctcttcagtgaa  3850
           ||||||||||||||||||||||||||||||||||||||||||||||||||
v.2  3642  CTGACAGCTTAGTCGAATACGGAGAGGGAGACCATGGTCTCTTCAGTGAA  3691

v.1  3851  gatggatcatttattggtgcctacgctggatctaaggagaagggatctgt  3900
           ||||||||||||||||||||||||||||||||||||||||||||||||||
v.2  3692  GATGGATCATTTATTGGTGCCTACGCTGGATCTAAGGAGAAGGGATCTGT  3741

v.1  3901  tgaaagcaatggaagttctacagcaacttttccccttcgggcataaacac  3950
           ||||||||||||||||||||||||||||||||||||||||||||||||||
v.2  3742  TGAAAGCAATGGAAGTTCTACAGCAACTTTTCCCCTTCGGGCATAAACAC  3791

v.1  3951  aacatatgtaagcaacgctactggttcaccccaaccttccatatttatct  4000
           ||||||||||||||||||||||||||||||||||||||||||||||||||
v.2  3792  AACATATGTAAGCAACGCTACTGGTTCACCCCAACCTTCCATATTTATCT  3841

v.1  4001  gttcaaaggagcaagaactttcatataggaatagaaacatgctggccgaa  4050
           ||||||||||||||||||||||||||||||||||||||||||||||||||
v.2  3842  GTTCAAAGGAGCAAGAACTTTCATATAGGAATAGAAACATGCTGGCCGAA  3891

v.1  4051  gatttcatccagaagtcaacatcctgcaattatgttgaaaagagtagtac  4100
           ||||||||||||||||||||||||||||||||||||||||||||||||||
v.2  3892  GATTTCATCCAGAAGTCAACATCCTGCAATTATGTTGAAAAGAGTAGTAC  3941

v.1  4101  tttcttcaaaatataaaatgccaagcacttcaggcctatgttttgcttat  4150
           ||||||||||||||||||||||||||||||||||||||||||||||||||
v.2  3942  TTTCTTCAAAATATAAAATGCCAAGCACTTCAGGCCTATGTTTTGCTTAT  3991

v.1  4151  attgttttcaggtgctcaaaatgcaaaacacaaaacaaatcctgcattta  4200
           ||||||||||||||||||||||||||||||||||||||||||||||||||
v.2  3992  ATTGTTTTCAGGTGCTCAAAATGCAAAACACAAAACAAATCCTGCATTTA  4041

v.1  4201  gatacacctcaactaaatccaaagtccccattcagtatattccatatttg  4250
           ||||||||||||||||||||||||||||||||||||||||||||||||||
v.2  4042  GATACACCTCAACTAAATCCAAAGTCCCCATTCAGTATATTCCATATTTG  4091

v.1  4251  cctgattttactattcggtgtgtttgcatagatgttgctacttggtgggt  4300
           ||||||||||||||||||||||||||||||||||||||||||||||||||
v.2  4092  CCTGATTTTACTATTCGGTGTGTTTGCATAGATGTTGCTACTTGGTGGGT  4141

v.1  4301  ttttctccgtatgcacattggtatacagtctctgagaactggcttggtga  4350
           ||||||||||||||||||||||||||||||||||||||||||||||||||
v.2  4142  TTTTCTCCGTATGCACATTGGTATACAGTCTCTGAGAACTGGCTTGGTGA  4191

v.1  4351  ctttgcttcactacaggttaaaagaccataagcaaactggttatttaaaa  4400
           ||||||||||||||||||||||||||||||||||||||||||||||||||
v.2  4192  CTTTGCTTCACTACAGGTTAAAAGACCATAAGCAAACTGGTTATTTAAAA  4241

v.1  4401  tgtaaaaaggaatatgaaagtcttattaaaacacttcattgaaaatatac  4450
```

TABLE LIIIa-continued

Nucleotide sequence alignment of 282P1G03 v.1 (SEQ ID NO: 152) and 282P1G03 v.2 (SEQ ID NO: 153)

```
               ||||||||||||||||||||||||||||||||||||||||||||||||||
v.2  4242  TGTAAAAAGGAATATGAAAGTCTTATTAAAACACTTCATTGAAAATATAC  4291

v.1  4451  agtctaaatttattatttaaattttactagcaaaagtcttaggtgaacaa  4500
           ||||||||||||||||||||||||||||||||||||||||||||||||||
v.2  4292  AGTCTAAATTTATTATTTAAATTTTACTAGCAAAAGTCTTAGGTGAACAA  4341

v.1  4501  tcaactagtatttgttgagctcctatttgcccagagatggtcatatttaa  4550
           ||||||||||||||||||||||||||||||||||||||||||||||||||
v.2  4342  TCAACTAGTATTTGTTGAGCTCCTATTTGCCCAGAGATGGTCATATTTAA  4391

v.1  4551  acagaagtatacgtttttcagtttcaacatgaatttttttatttctgtca  4600
           ||||||||||||||||||||||||||||||||||||||||||||||||||
v.2  4392  ACAGAAGTATACGTTTTTCAGTTTCAACATGAATTTTTTTATTTCTGTCA  4441

v.1  4601  gttatgacatccacgagcatcactttttgtgtctgtttttttttttttct  4650
           ||||||||||||||||||||||||||||||||||||||||||||||||||
v.2  4442  GTTATGACATCCACgAGCATCACTTTTTGTGTCTGTTTTTTTTTTTTTCT  4491

v.1  4651  tggactaaattcaactgcatggaagcggtggtcagaaggttgttttatac  4700
           ||||||||||||||||||||||||||||||||||||||||||||||||||
v.2  4492  TGGACTAAATTCAACTGCATGGAAGCGGTGGTCAGAAGGTTGTTTTATAC  4541

v.1  4701  gagaacaggcagaaagtgcccattgttcaggattctaatagctacatcta  4750
           ||||||||||||||||||||||||||||||||||||||||||||||||||
v.2  4542  GAGAACAGGCAGAAAGTGCCCATTGTTCAGGATTCTAATAGCTACATCTA  4591

v.1  4751  cttaatatcttcatttctaaattgactgcttttaccttttctcatgttt  4800
           ||||||||||||||||||||||||||||||||||||||||||||||||||
v.2  4592  CTTAATATCTTCATTTCTAAATTGACTGCTTTTACCTTTTTCTCATGTTT  4641

v.1  4801  atataatggtatgcttgcatatatttcatgaatacattgtacatattatg  4850
           ||||||||||||||||||||||||||||||||||||||||||||||||||
v.2  4642  ATATAATGGTATGCTTGCATATATTTCATGAATACATTGTACATATTATG  4691

v.1  4851  ttaatatttacacaatttaaaatatagatgtgttttattttgaagtgaga  4900
           ||||||||||||||||||||||||||||||||||||||||||||||||||
v.2  4692  TTAATATTTACACAATTTAAAATATAGATGTGTTTTATTTTGAAGTGAGA  4741

v.1  4901  aaatgaacattaacaggcatgtttgtacagctagaatatattagtaagat  4950
           ||||||||||||||||||||||||||||||||||||||||||||||||||
v.2  4742  AAATGAACATTAACAGGCATGTTTGTACAGCTAGAATATATTAGTAAGAT  4791

v.1  4951  actgtttttcgtcattccagagctacaactaataacacgaggttccaaag  5000
           ||||||||||||||||||||||||||||||||||||||||||||||||||
v.2  4792  ACTGTTTTTCGTCATTCCAGAGCTACAACTAATAACACGAGGTTCCAAAG  4841

v.1  5001  ctgaagactttgtataaagtatttgggttttgttcttgtattgctttctt  5050
           ||||||||||||||||||||||||||||||||||||||||||||||||||
v.2  4842  CTGAAGACTTTGTATAAAGTATTTGGGTTTTGTTCTTGTATTGCTTTCTT  4891

v.1  5051  tcaacagtttcaaaataaaatatcatacaaatattgagggaaatgttttc  5100
           ||||||||||||||||||||||||||||||||||||||||||||||||||
v.2  4892  TCAACAGTTTCAAAATAAAATATCATACAAATATTGAGGGAAATGTTTTC  4941

v.1  5101  atatttttcaaaataggtttttattgttgaatgtacatctaccccagccc  5150
           ||||||||||||||||||||||||||||||||||||||||||||||||||
v.2  4942  ATATTTTTCAAAATAGGTTTTTATTGTTGAATGTACATCTACCCCAGCCC  4991

v.1  5151  ctcaaaagaaaaactgtttacatagaaattcctacacatacgtttgcgta  5200
           ||||||||||||||||||||||||||||||||||||||||||||||||||
v.2  4992  CTCAAAAGAAAAACTGTTTACATAGAAATTCCTACACATACGTTTOCGTA  5041

v.1  5201  tatgttattttaaacatctttgtggtgagaatttttttccccgatattctc  5250
           ||||||||||||||||||||||||||||||||||||||||||||||||||
v.2  5042  TATGTTATTTTAAACATCTTTGTGGTGAGAATTTTTTCCCCGATATTCTC  5091

v.1  5251  cttctgtcaaagtcagaacaaattcagggaatttattttctggcagttgt  5300
           ||||||||||||||||||||||||||||||||||||||||||||||||||
v.2  5092  CTTCTGTCAAAGTCAGAACAAATTCAGGGAATTTATTTTCTGGCAGTTGT  5141

v.1  5301  gctccagtccttttaaaattgtacatgaacatgttttagaaacaatatgg  5350
           ||||||||||||||||||||||||||||||||||||||||||||||||||
v.2  5142  GCTCCAGTCCTTTTAAAATTGTACATGAACATGTTTTAGAAACAATATGG  5191

v.1  5351  aggatgatgcatacatgtcggtcaagttcagcgctcgacattttatggaa  5400
```

TABLE LIIIa-continued

Nucleotide sequence alignment of 282P1G03 v.1 (SEQ ID NO: 152) and 282P1G03 v.2 (SEQ ID NO: 153)

```
                ||||||||||||||||||||||||||||||||||||||||||||||||||
v.2  5192  AGGATGATGCATACATGTCGGTCAAGTTCAGCGCTCGACATTTTATGGAA  5241

v.1  5401  agatttttttaaccttaccacgaaatacttaactactgtttaagtgaatt  5450
                ||||||||||||||||||||||||||||||||||||||||||||||||||
v.2  5242  AGATTTTTTTAACCTTACCACGAAATACTTAACTACTGTTTAAGTGAATT  5291

v.1  5451  gacttatttcactttagtttttgaactgtgattattggtatactgttata  5500
                ||||||||||||||||||||||||||||||||||||||||||||||||||
v.2  5292  GACTTATTTCACTTTAGTTTTTGAACTGTGATTATTGGTATACTGTTATA  5341

v.1  5501  tcctcaacttggatttatggtaacccctttttagttcatggagaccaaaat  5550
                ||||||||||||||||||||||||||||||||||||||||||||||||||
v.2  5342  TCCTCAACTTGGATTTATGGTAACCCCTTTTAGTTCATGGAGACCAAAAT  5391

v.1  5551  ttggggtatttataatagtcagcgcaggaatgcacatggaatatctactt  5600
                ||||||||||||||||||||||||||||||||||||||||||||||||||
v.2  5392  TTGGGGTATTTATAATAGTCAGCGCAGGAATGCACATGGAATATCTACTT  5441

v.1  5601  gtccttttgaacctcacgagtcatccagaatgtatagacaggaaaagcat  5650
                ||||||||||||||||||||||||||||||||||||||||||||||||||
v.2  5442  GTCCTTTTGAACCTCACGAGTCATCCAGAATGTATAGACAGGAAAAGCAT  5491

v.1  5651  gtcttatttaaaactgtaatttatgggctcaggatctgaccgcagtcccg  5700
                ||||||||||||||||||||||||||||||||||||||||||||||||||
v.2  5492  GTCTTATTTAAAACTGTAATTTATGGGCTCAGGATCTGACCGCAGTCCCG  5541

v.1  5701  ggagtaagcatttcaaaggggggaaggcagtgtggtccctaccctgtgtga  5750
                ||||||||||||||||||||||||||||||||||||||||||||||||||
v.2  5542  GGAGTAAGCATTTCAAAGGGGGAAGGCAGTGTGGTCCCTACCCTGTGTGA  5591

v.1  5751  atgtgaggatgtagacatccatcagtgcaactcgagctccatcctcctcc  5800
                ||||||||||||||||||||||||||||||||||||||||||||||||||
v.2  5592  ATGTGAGGATGTAGACATCCATCAGTGCAACTCGAGCTCCATCCTCCTCC  5641

v.1  5801  gatttctaaggctccagttttctggagggacagtcatcatgttttgattt  5850
                ||||||||||||||||||||||||||||||||||||||||||||||||||
v.2  5642  GATTTCTAAGGcTCCAGTTTTCTGGAGGGACAGTCATCATGTTTTGATTT  5691

v.1  5851  atctgggagaaaactgtggtgcacagcttgtgaggagggcaaggttgtga  5900
                ||||||||||||||||||||||||||||||||||||||||||||||||||
v.2  5692  ATCTGGGAGAAAACTGTGGTGCACAGCTTGTGAGGAGGGCAAGGTTGTGA  5741

v.1  5901  cgttcgagcttagttctggtgttattctgtctcctcttctttgtcatcag  5950
                ||||||||||||||||||||||||||||||||||||||||||||||||||
v.2  5742  CGTTCGAGCTTAGTTCTGGTGTTATTCTGTCTCCTCTTCTTTGTCATCAG  5791

v.1  5951  ccaaaacgtggtttttaaagagagtcatgcaggttagaaataatgtcaaa  6000
                ||||||||||||||||||||||||||||||||||||||||||||||||||
v.2  5792  CCAAAACGTGGTTTTTAAAGAGAGTCATGCAGGTTAGAAATAATGTCAAA  5841

v.1  6001  aatatttaggaatttaataacctttaagtcagaaactaaaacaaatactg  6050
                ||||||||||||||||||||||||||||||||||||||||||||||||||
v.2  5842  AATATTTAGGAATTTAATAACCTTTAAGTCAGAAACTAAAACAAATACTG  5891

v.1  6051  aaatattagctcttcctacacttcgtgttcccctttagctgcctgaaaat  6100
                ||||||||||||||||||||||||||||||||||||||||||||||||||
v.2  5892  AAATATTAGCTCTTCCTACACTTCGTCTTCCCCTTTAGCTGCCTGAAAAT  5941

v.1  6101  caagattgctcctactcagatcttctgagtggctaaaacttatggatatg  6150
                ||||||||||||||||||||||||||||||||||||||||||||||||||
v.2  5942  CAAGATTGCTCCTaCTCAGATCTTCTGAGTGGCTAAAACTTATGGATATG  5991

v.1  6151  aaaaatgagattgaatgatgactatgctttgctatcattgttacctttcc  6200
                ||||||||||||||||||||||||||||||||||||||||||||||||||
v.2  5992  AAAAATGAGATTGAATGATGACTATGCTTTGCTATCATTGTTACCTTTCC  6041

v.1  6201  tcaatactatttggcaactactgggactcttcagcacaaaaggaatagat  6250
                ||||||||||||||||||||||||||||||||||||||||||||||||||
v.2  6042  TCAATACTATTTGGCAACTACTGGGACTCTTCAGCACAAAAGGAATAGAT  6091

v.1  6251  ctatgattgaccctgattttaattgtgaaattatatgattcatatatttt  6300
                ||||||||||||||||||||||||||||||||||||||||||||||||||
v.2  6092  CTATGATTGACCCTGATTTTAATTGTGAAATTATATGATTCATATATTTT  6141

v.1  6301  atgaatcagaataaccttcaaataaaataaatctaagtcggttaaaatgg  6350
```

TABLE LIIIa-continued

Nucleotide sequence alignment of 282P1G03 v.1 (SEQ ID NO: 152) and 282P1G03 v.2 (SEQ ID NO: 153)

```
               ||||||||||||||||||||||||||||||||||||||||||||||||||
v.2  6142  ATGAATCAGAATAACCTTCAAATAAAATAAATCTAAGTCGGTTAAAATGG  6191

v.1  6351  atttcatgattttccctcagaaaatgagtaacggagtccacggcgtgcaa  6400
           ||||||||||||||||||||||||||||||||||||||||||||||||||
v.2  6192  ATTTCATGATTTTCCCTCAGAAAATGAGTAACgGAGTCCACGGCGTGCAA  6241

v.1  6401  tggtaattataaattggtgatgcttgtttgcaaattgcccactcgtgata  6450
           ||||||||||||||||||||||||||||||||||||||||||||||||||
v.2  6242  TGGTAATTATAAATTGGTGATGCTTGTTTGCAAATTGCCCACTCGTGATA  6291

v.1  6451  agtcaacagccaatatttaaaactttgttcgttactggctttaccctaac  6500
           ||||||||||||||||||||||||||||||||||||||||||||||||||
v.2  6292  AGTCAACAGCCAATATTTAAAACTTTGTTCGTTACTGGCTTTACCCTAAC  6341

v.1  6501  tttctctagtctactgtcaatatcattttaatgtaattgattgtatatag  6550
           ||||||||||||||||||||||||||||||||||||||||||||||||||
v.2  6342  TTTCTCTAGTCTACTGTCAATATCATTTTAATGTAATTGATTGTATATAG  6391

v.1  6551  tctcaagaatggttggtgggcatgagttcctagagaactgtccaagggtt  6600
           ||||||||||||||||||||||||||||||||||||||||||||||||||
v.2  6392  TCTCAAGAATGGTTGGTGGGCATGAGTTCCTAGAGAACTGTCCAAGGGTT  6441

v.1  6601  gggaaaatccaaattctcttcctggctccagcactgattttgtacataaa  6650
           ||||||||||||||||||||||||||||||||||||||||||||||||||
v.2  6442  GGGAAAATCCAAATTCTCTTCCTGGcTCCAGCACTGATTTTGTACATAAA  6491

v.1  6651  cattaggcaggttgcttaaccttttatttcaaactctctcaactctaaa  6700
           ||||||||||||||||||||||||||||||||||||||||||||||||||
v.2  6492  CATTAGGCAGGTTGCTTAACCTTTTATTTCAAACTCTCTCAACTCTAAA  6541

v.1  6701  gtgctaataataatctcagttaccttatctttgtcacagggtgttctttt  6750
           ||||||||||||||||||||||||||||||||||||||||||||||||||
v.2  6542  GTGCTAATAATAATCTCAGTTACCTTATCTTTGTCACAGGGTGTTCTTTT  6591

v.1  6751  ttatgaagaaaaatttgaaaatgataaaagctaagatgccttctaacttc  6800
           ||||||||||||||||||||||||||||||||||||||||||||||||||
v.2  6592  TTATGAAGAAAAATTTGAAAATGATAAAAGCTAAGATGCCTTCTAACTTC  6641

v.1  6801  ataagcaaacctttaactaattatgtatctgaaagtcacccccacatacc  6850
           ||||||||||||||||||||||||||||||||||||||||||||||||||
v.2  6642  ATAAGCAAACCTTTAACTAATTATGTATCTGAAAGTCACCCCCACATACC  6691

v.1  6851  aactcaactttttttcctgtgaacacataaatatatttttatagaaaaaca  6900
           ||||||||||||||||||||||||||||||||||||||||||||||||||
v.2  6692  AACTCAACTTTTTTCCTGTGAACACATAAATATATTTTTATAGAAAAACA  6741

v.1  6901  aatctacataaaataaatctactgtttagtgagcagtatgacttgtacat  6950
           ||||||||||||||||||||||||||||||||||||||||||||||||||
v.2  6742  AATCTACATAAAATAAATCTACTGTTTAGTGAGCAGTATGAcTTGTACAT  6791

v.1  6951  agccattgaaaattattaatcagaagaaaattaagcagggtctttgctata 7000
           ||||||||||||||||||||||||||||||||||||||||||||||||||
v.2  6792  GCCATTGAAAATTATTAATCAGAAGAAAATTAAGCAGGGTCTTTGCTATA  6841

v.1  7001  caaaagtgttttccactaattttgcatgcgtatttataagaaaaatgtga  7050
           ||||||||||||||||||||||||||||||||||||||||||||||||||
v.2  6842  CAAAAGTCTTTTCCACTAATTTTGCATGCGTATTTATAAGAAAAATGTGA  6891

v.1  7051  atttggtggttttattctatcggtataaaggcatcgatattttagatgca  7100
           ||||||||||||||||||||||||||||||||||||||||||||||||||
v.2  6892  ATTTGGTGGTTTTATTCTATCGGTATAAAGGCATCGATATTTTAGATGCA  6941

v.1  7101  cccgtgtttgtaaaaatgtagagcacaatggaattatgctggaagtctca  7150
           ||||||||||||||||||||||||||||||||||||||||||||||||||
v.2  6942  CCCGTGTTTGTAAAAATGTAGAGCACAATGGAATTATGCTGGAAGTCTCA  6991

v.1  7151  aataatatttttttcctattttatactcatggaagagataagctaaagag  7200
           ||||||||||||||||||||||||||||||||||||||||||||||||||
v.2  6992  AATAATATTTTTTTCCTATTTTATACTCATGGAAGAGATAAGCTAAAGAG  7041

v.1  7201  gggacaataatgagaaatgttggtgtgcttttctaagcatttaaaacata  7250
           ||||||||||||||||||||||||||||||||||||||||||||||||||
v.2  7042  GGGACAATAATGAGAAATGTTGGTGTGCTTTTCTAAGCATTTAAAACATA  7091

v.1  7251  attgccaattgaaaccctaaatatgtttacataccattaagatatgattc  7300
```

TABLE LIIIa-continued

Nucleotide sequence alignment of 282P1G03 v.1 (SEQ ID NO: 152) and 282P1G03 v.2 (SEQ ID NO: 153)

||||||||||||||||||||||||||||||||||||||||||||||||||
v.2 7092 ATTGCCAATTGAAACCCTAAATATGTTTACATACCATTAAGATATGATTC 7141 v.1 7301 atgtaacaatgttaaattaattataatgggattgggtttgttatctgtgg 7350
||||||||||||||||||||||||||||||||||||||||||||||||||
v.2 7142 ATGTAACAATGTTAAATTAATTATAATGGGATTGGGTTTGTTATCTGTGG 7191 v.1 7351 tagtatatatcctagtgttcctatagtgaaataagtagggttcagccaaa 7400
||||||||||||||||||||||||||||||||||||||||||||||||||
v.2 7192 TAGTATATATCCTAGTGTTCCTATAGTGAAATAAGTAGGGTTCAGCCAAA 7241 v.1 7401 gctttctttgttttgtaccttaaattgttcgattacgtcatcaaaagaga 7450
||||||||||||||||||||||||||||||||||||||||||||||||||
v.2 7242 GCTTTCTTTGTTTTGTACCTTAAATTGTTCGATTACGTCATCAAAAGAGA 7291 v.1 7451 tgaaaggtatgtagaacaggttcacgtgattacctttttcttttggcttg 7500
||||||||||||||||||||||||||||||||||||||||||||||||||
v.2 7292 TGAAAGGTATGTAGAACAGGTTCACGTGATTACCTTTTTCTTTTGGCTTG 7341 v.1 7501 gattaatattcatagtagaactttataaaacgtgtttgtattgtaggtgg 7550
||||||||||||||||||||||||||||||||||||||||||||||||||
v.2 7342 GATTAATATTCATAGTAGAACTTTATAAAACGTGTTTGTATTGTAGGTGG 7391 v.1 7551 tgtttgtattatgcttatgactatgtatggtttgaaaatattttcattat 7600
||||||||||||||||||||||||||||||||||||||||||||||||||
v.2 7392 TGTTTGTATTATGCTTATGACTATGTATGGTTTGAAAATATTTTCATTAT 7441 v.1 7601 acatgaaattcaactttccaaataaaagttctacttcatgtaatccaaaa 7650
||||||||||||||||||||||||||||||||||||||||||||||||||
v.2 7442 ACATGAAATTCAACTTTCCAAATAAAAGTTCTACTTCATGTAATCCAAAA 7491

Note:
Two SNP at 668 and 1178.

TABLE LIVa

Peptide sequences of protein coded by 282P1G03 v.2

(SEQ ID NO:154)

MEPLLLGRGL IVYLMFLLLK FSKAIEIPSS VQQVPTIIKQ SKVQVAFPFD EYFQIECEAK 60

GNPEPTFSWT KDGNPFYFTD HRIIPSNNSG TFRIPNEGHI SHFQGKYRCF ASNKLGIANS 120

EEIEFIVPSV PKFPKEKIDP LEVEEGDPIV LPCNPPKGLP PLHIYWMNIE LEHIEQDERV 180

YMSQKGDLYF ANVEEKDSRN DYCCFAAFPR LRTIVQKMPM KLTVNSLKHA NDSSSSTEIG 240

SKANSIKQRK PKLLLPPTES GSESSITILK GEILLLECFA EGLPTPQVDW NKIGGDLPKG 300

REAKENYGKT LKIENVSYQD KGNYRCTASN FLGTATHDFH VIVEEPPRWT KKPQSAVYST 360

GSNGILLCEA EGEPQPTIKW RVNGSPVDNH PFAGDVVFPR EISFTNLQPN HTAVYQCEAS 420

NVHGTILANA NIDVVDVRPL IQTKDGENYA TVVGYSAFLH CEFFASPEAV VSWQKVEEVK 480

PLEGRRYHIY ENGTLQINRT TEEDAGSYSC WVENATGKTA VTANLDIRNA TKLRVSPKUP 540

RIPKLHMLEL HCESKCDSHL KHSLKLSWSK DGEAFEINGT EDGRIIIDGA NLTISNVTLE 600

DQGIYCCSAH TALDSAADIT QVTVLDVPDP PENLHLSERQ NRSVRLTWEA GADHNSNISE 660

YIVEFEGNKE EPGRWEELTR VQGKKTTVIL PLAPFVRYQF RVIAVNEVGR SQPSQPSDHH 720

ETPPAAPDRN PQNIRVQASQ PKEMIIKWEP LKSMEQNGPG LEYRVTWKPQ GAPVEWEEET 780

VTNHTLRVMT PAVYAPYDVK VQAINQLGSG PDPQSVTLYS GEDYPDTAPV IHGVDVINST 840

LVKVTWSTVP KDRVHGRLKG YQINWWKTKS LLDGRTHPKE VNILRFSGQR NSGMVPSLDA 900

FSEFHLTVLA YNSKGAGPES EPYIFQTPEG VPEQPTFLKV IKVDKDTATL SWGLPKKLNG 960

NLTGYLLQYQ IINDTYEIGE LNDTNITTPS KPSWHLSNLN ATTKYKFYLR ACTSQGCGKP 1020

ITEESSTLCE GKYAGLYDDI STQGWFIGLM CAIALLTLLL LTVCFVKRNR GGKYSVKEKE 1080

TABLE LIVa-continued

| Peptide sequences of protein coded by 282P1G03 v.2 |
|---|
| DLHPDPEIQS VKDETFGEYS DSDEKPLKGS LRSLNRDMQP TESADSLVEY GEGDHGLFSE 1140 |
| DGSFIGAYAG SKEKGSVESN GSSTATFPLR A 1171 |

TABLE LVa

Amino acid sequence alignment of 282P1G03 v.1 (SEQ ID NO: 155) and 282P1G03 v.2 (SEQ ID NO: 156)

```
v.1    1  MEPLLLGRGLIVYLMFLLLKFSKAIEIPSSVQQVPTIIKQSKVQVAFPFD   50
          ||||||||||||||||||||||||||||||||||||||||||||||||||
v.2    1  MEPLLLGRGLIVYLMFLLLKFSKAIEIPSSVQQVPTIIKQSKVQVAFPFD   50

v.1   51  EYFQIECEAKGNPEPTFSWTKDGNPFYFTDHRIIPSNNSGTFRIPNEGHI  100
          ||||||||||||||||||||||||||||||||||||||||||||||||||
v.2   51  EYFQIECEAKGNPEPTFSWTKDGMPFYFTDHRIIPSNNSGTFRIPNEGHI  100

v.1  101  SHFQGKYRCFASNKLGIAMSEEIEFIVPSVPKLPKEKIDPLEVEEGDPIV  150
          ||||||||||||||||||||||||||||||||||||||||||||||||||
v.2  101  SHFQGKYRCFASNKLGIAMSEEIEFIVPSVPKFPKEKIDPLEVEEGDPIV  150

v.1  151  LPCNPPKGLPPLHIYWMNIELEHIEQDERVYMSQKGDLYFANVEEKDSRI  200
          ||||||||||||||||||||||||||||||||||||||||||||||||||
v.2  151  LPCNPPKGLPPLHIYWMNIELEHIEQDERVYMSQKGDLYFANVEEKDSRN  200

v.1  201  DYCCFAAFPRLRTIVQKMPMKLTVNSLKHANDSSSSTEIGSKANSIKQRK  250
          ||||||||||||||||||||||||||||||||||||||||||||||||||
v.2  201  DYCCFAAFPRLRTIVQKMPMKLTVNSLKHANDSSSSTEIGSKANSIKQRK  250

v.1  251  PKLLLPPTESGSESSITILKGEILLLECFAEGLPTPQVDWNKIGGDLPKG  300
          ||||||||||||||||||||||||||||||||||||||||||||||||||
v.2  251  PKLLLPPTESGSESSITILKGEILLLECFAEGLPTPQVDWNKIGGDLPKG  300

v.1  301  RETKENYGKTLKIENVSYQDKGMYRCTASNFLGTATHDFHVIVEEPPRWT  350
          ||||||||||||||||||||||||||||||||||||||||||||||||||
v.2  301  REAKENYGKTLKIENVSYQDKGNYRCTASNFLGTATHDFHVIVEEPPRWT  350

v.1  351  KKPQSAVYSTGSNGILLCEAEGEPQPTIKWRVNGSPVDHHPFAGDVVFPR  400
          ||||||||||||||||||||||||||||||||||||||||||||||||||
v.2  351  KKPQSAVYSTGSNGILLCEAEGEPQPTIKWRVNGSPVDNHPFAGDVVFPR  400

v.1  401  EISFTNLQPNHTAVYQCEASNVHGTILANANIDVVDVRPLIQTKDGENYA  450
          ||||||||||||||||||||||||||||||||||||||||||||||||||
v.2  401  EISFTNLQPNHTAVYQCEASNVHGTILANANIDVVDVRPLIQTKDGENYA  450

v.1  451  TVVGYSAFLHCEFFASPEAVVSWQKVEEVKPLEGRRYHIYENGTLQINRT  500
          ||||||||||||||||||||||||||||||||||||||||||||||||||
v.2  451  TVVGYSAFLHCEFFASPEAVVSWQKVEEVKPLEGRRYHIYENGTLQINRT  500

v.1  501  TEEDAGSYSCWVENAIGKTAVTANLDIRNATKLRVSPKNPRIPKLHMLEL  550
          ||||||||||||||||||||||||||||||||||||||||||||||||||
v.2  501  TEEDAGSYSCWVENAIGKTAVTANLDIRNATKLRVSPKNPRIPKLHMLEL  550

v.1  551  HCESKCDSHLKHSLKLSWSKDGEAFEINGTEDGRIIIDGANLTISNVTLE  600
          ||||||||||||||||||||||||||||||||||||||||||||||||||
v.2  551  HCESKCDSHLKHSLKLSWSKDGEAFEINGTEDGRIIIDGANLTISNVTLE  600

v.1  601  DQGIYCCSAHTALDSAADITQVTVLDVPDPPENLHLSERQNRSVRLTWEA  650
          ||||||||||||||||||||||||||||||||||||||||||||||||||
v.2  601  DQGIYCCSAHTALDSAADITQVTVLDVPDPPENLHLSERQNRSVRLTWEA  650

v.1  651  GADHNSMISEYIVEFEGNKEEPGRWEELTRVQGKKTTVILPLAPFVRYQF  700
          ||||||||||||||||||||||||||||||||||||||||||||||||||
v.2  651  GADHNSNISEYIVEFEGNKEEPGRWEELTRVQGKKTTVILPLAPFVRYQF  700

v.1  701  RVIAVNEVGRSQPSQPSDHHETPPAAPDRNPQNIRVQASQPKEMIIKWEP  750
          ||||||||||||||||||||||||||||||||||||||||||||||||||
v.2  701  RVIAVNEVGRSQPSQPSDHHETPPAAPDRNPQNIRVQASQPKEMIIKWEP  750

v.1  751  LKSMEQNGPGLEYRVTWKPQGAPVEWEEETVTNHTLRVMTPAVYAPYDVK  800
          ||||||||||||||||||||||||||||||||||||||||||||||||||
v.2  751  LKSMEQNGPGLEYRVTWKPQGAPVEWEEETVThHTLRVMTPAVYAPYDVK  800
```

TABLE LVa-continued

Amino acid sequence alignment of 282P1G03 v.1 (SEQ ID NO: 155) and 282P1G03 v.2 (SEQ ID NO: 156)

```
v.1   801  VQAINQLGSGPDPQSVTLYSGEDYPDTAPVIHGVDVINSTLVKVTWSTVP  850
           ||||||||||||||||||||||||||||||||||||||||||||||||||
v.2   801  VQAINQLGSGPDPQSVTLYSGEDYPDTAPVIHGVDVINSTLVKVTWSTVP  850

v.1   851  KDRVHGRLKGYQINWWKTKSLLDGRTHPKEVNILRFSGQRNSGMVPSLDA  900
           ||||||||||||||||||||||||||||||||||||||||||||||||||
v.2   851  KDRVHGRLKGYQINWWKTKSLLDGRTHPKEVNILRFSGQRNSGMVPSLDA  900

v.1   901  FSEFHLTVLAYNSKGAGPESEPYIFQTPEGVPEQPTFLKVIKVDKDTATL  950
           ||||||||||||||||||||||||||||||||||||||||||||||||||
v.2   901  FSEFHLTVLAYNSKGAGPESEPYIFQTPEGVPEQPTFLKVIKVDKDTATL  950

v.1   951  SWGLPKKLNGNLTGYLLQYQIINDTYEIGELNDINITTPSKPSWHLSNLN  1000
           ||||||||||||||||||||||||||||||||||||||||||||||||||
v.2   951  SWGLPKKLNGNLTGYLLQYQIINDTYEIGELNDINITTPSKPSWHLSNLN  1000

v.1  1001  ATTKYKFYLRACTSQGCGKPITEESSTLGEGSKGIGKISGVNLTQKTHPI  1050
           ||||||||||||||||||||||||||||||||
v.2  1001  ATTKYKFYLRACTSQGCGKPITEESSTLGEG-------------------  1031

v.1  1051  EVFEPGAEHIVRLMTKNWGDNDSIFQDVIETRGREYAGLYDDISTQGWFI  1100
                                                  :||||||||||||||
v.2  1032  ----------------------------------KYAGLYDDISTQGWFI  1047

v.1  1101  GLMCAIALLTLLLLTVCFVKRNRGGKYSVKEKEDLHPDPEIQSVKDETFG  1150
           ||||||||||||||||||||||||||||||||||||||||||||||||||
v.2  1048  GLMCAIALLTLLLLTVCFVKRNRGGKYSVKEKEDLHPDPEIQSVKDETFG  1097

v.1  1151  EYSDSDEKPLKGSLRSLNRDMQPTESADSLVEYGEGDHGLFSEDGSFIGA  1200
           ||||||||||||||||||||||||||||||||||||||||||||||||||
v.2  1098  EYSDSDEKPLKGSLRSLNRDMQPTESADSLVEYGEGDHGLFSEDGSFIGA  1147

v.1  1201  YAGSKEKGSVESNGSSTATFPLRA 1224
           ||||||||||||||||||||||||
v.2  1148  YAGSKEKGSVESNGSSTATFPLRA 1171
```

TABLE LIIb

Nucleotide sequence of transcript variant 282P1G03 v.3

(SEQ ID NO:157)

```
cggaccctgc gcgcccccgt cccggctccc ggccggctcg ggggagaagg cgcccgaggg  60
gaggcgccgg acagatcgcg tttcggaggc ggcgcaggtg ctgtaaactg caaaccataa  120
tcctgtctta atactgcaaa caaatcatag tggaactaag ggaacttaa tttactgttt  180
ccaggttaac taaggtctca gctgtaaacc aaaagtgaga ggagacatta agattttcat  240
tcttaccggg ttgtcttctt cctgaagagc aatggagccg cttttacttg gaagaggact  300
aatcgtatat ctaatgttcc tcctgttaaa attctcaaaa gcaattgaaa taccatcttc  360
agttcaacag gttccaacaa tcataaaaca gtcaaaagtc caagttgcct ttcccttcga  420
tgagtatttt caaattgaat gtgaagctaa aggaaatcca gaaccaacat tttcgtggac  480
taaggatggc aacccttttt atttcactga ccatcggata attccatcga acaattcagg  540
aacattcagg atcccaaacg aggggcacat atctcacttt caagggaaat accgctgctt  600
tgcttcaaat aaactgggaa tcgctatgtc agaagaaata gaatttatag ttccaagtgt  660
tccaaaactc ccaaaagaaa aaattgaccc tcttgaagtg gaggagggag atccaattgt  720
cctcccatgc aatcctccca aaggcctccc acctttacac atttattgga tgaatattga  780
attagaacac atcgaacaag atgaaagagt atacatgagc caaaagggag atctatactt  840
cgcaaacgtg gaagaaaagg acagtcgcaa tgactactgt tgctttgctg catttccaag  900
attaaggact attgtacaga aaatgccaat gaaactaaca gttaacagtt taaagcatgc  960
```

TABLE LIIb-continued

| Nucleotide sequence of transcript variant 282P1G03 v.3 |
|---|
| taatgactca agttcatcca cagaaattgg ttccaaggca aattccatca agcaaagaaa 1020 |
| acccaaactg ctgttgcctc ccactgagag tggcagtgag tcttcaatta ccatcctcaa 1080 |
| aggggaaatc ttgctgcttg agtgttttgc tgaaggcttg ccaactccac aggttgattg 1140 |
| gaacaaaatt ggtggtgact taccaaaggg gagagaaaca aaagaaaatt atggcaagac 1200 |
| tttgaagata gagaatgtct cctaccagga caaaggaaat tatcgctgca cagccagcaa 1260 |
| tttcttggga acagccactc acgattttca cgttatagta gaagagcctc ctcgctggac 1320 |
| aaagaagcct cagagtgctg tgtatagcac cggaagcaat ggcaccttgt tatgtgaggc 1380 |
| tgaaggagaa cctcaaccca caatcaagtg gagagtcaat ggctccccag ttgacaatca 1440 |
| tccatttgct ggtgatgttg tcttccccag ggaaatcagt tttaccaacc ttcaaccaaa 1500 |
| tcatactgct gtgtaccagt gtgaagcctc aaatgtccat ggaactatcc ttgccaatgc 1560 |
| caatattgat gttgtggatg tccgtccatt gatacaaacc aaagatggag aaaattacgc 1620 |
| tacagtggtt gggtacagtg ctttcttaca ttgcgagttc tttgcttcac ctgaggcagt 1680 |
| cgtgtcctgg cagaaggtgg aagaagtgaa acccctggag ggcaggcggt atcatatcta 1740 |
| tgaaaatggc acattgcaga tcaacagaac caccgaagaa gatgctgggt cttactcatg 1800 |
| ttgggtagaa aatgctatag gaaaaactgc agtcacagcc aatttggata ttagaaatgc 1860 |
| tacaaaactt agagtttctc ctaagaatcc tcgtatcccc aaattgcata tgcttgaatt 1920 |
| acattgtgaa agcaaatgtg actcacattt gaaacacagt ttgaagttgt cctggagtaa 1980 |
| agatggagaa gcctttgaaa ttaatggcac agaagatggc aggataatta ttgatggagc 2040 |
| taatttgacc atatctaatg taactttaga ggaccaaggt atttactgct gttcagctca 2100 |
| tactgctcta gacagtgctg ccgatataac tcaagtaact gttcttgatg ttccggatcc 2160 |
| accagaaaac cttcacttgt ctgaaagaca gaacaggagt gttcggctga cctgggaagc 2220 |
| tggagctgac cacaacagca atattagcga gtatattgtt gaatttgaag gaaacaaaga 2280 |
| agagcctgga aggtgggagg aactgaccag agtccaagga aagaaaacca cagttatctt 2340 |
| acctttggct ccatttgtga gataccagtt cagggtcata gccgtgaacg aagtagggag 2400 |
| aagtcagcct agccagccgt cagaccatca tgaaacacca ccagcagctc cagataggaa 2460 |
| tccacaaaac ataagggttc aagcctctca acccaaggaa atgattataa agtgggagcc 2520 |
| tttgaaatcc atggagcaga atggaccagg cctagagtac agagtgacct ggaagccaca 2580 |
| gggagcccca gtggagtggg aagaagaaac agtcacaaac cacacattgc gggtgatgac 2640 |
| gcctgctgtc tatgcccctt atgatgtcaa ggtccaggct atcaatcaac taggatctgg 2700 |
| gcctgaccct cagtcagtga ctctctattc tggagaagac tatcctgata cagctccagt 2760 |
| gatccatggg gtggacgtta taaacacaac atatgtaagc aacgctactg gttcacccca 2820 |
| accttccata tttatctgtt caaaggagca agaactttca tataggaata gaaacatgct 2880 |
| ggccgaagat ttcatccaga agtcaacatc ctgcaattat gttgaaaaga gtagtacttt 2940 |
| cttcaaaata taaaatgcca agcacttcag gcctatgttt tgcttatatt gttttcaggt 3000 |
| gctcaaaatg caaaacacaa aacaaatcct gcatttagat acacctcaac taaatccaaa 3060 |
| gtccccattc agtatattcc atatttgcct gattttacta ttcggtgtgt ttgcatagat 3120 |
| gttgctactt ggtgggtttt tctccgtatg cacattggta tacagtctct gagaactggc 3180 |
| ttggtgactt tgcttcacta caggttaaaa gaccataagc aaactggtta tttaaaatgt 3240 |
| aaaaaggaat atgaaagtct tattaaaaca cttcattgaa aatatacagt ctaaatttat 3300 |

TABLE LIIb-continued

| Nucleotide sequence of transcript variant 282P1G03 v.3 |
|---|
| tatttaaatt ttactagcaa aagtcttagg tgaacaatca actagtattt gttgagctcc 3360 |
| tatttgccca gagatggtca tatttaaaca gaagtatacg tttttcagtt tcaacatgaa 3420 |
| tttttttatt tctgtcagtt atgacatcca cgagcatcac tttttgtgtc tgtttttttt 3480 |
| tttttcttgg actaaattca actgcatgga agcggtggtc agaaggttgt tttatacgag 3540 |
| aacaggcaga aagtgcccat tgttcaggat tctaatagct acatctactt aatatcttca 3600 |
| tttctaaatt gactgctttt accttttttct catgtttata taatggtatg cttgcatata 3660 |
| tttcatgaat acattgtaca tattatgtta atatttacac aatttaaaat atagatgtgt 3720 |
| tttattttga agtgagaaaa tgaacattaa caggcatgtt tgtacagcta gaatatatta 3780 |
| gtaagatact gtttttcgtc attccagagc tacaactaat aacacgaggt tccaaagctg 3840 |
| aagactttgt ataaagtatt tgggttttgt tcttgtattg ctttctttca acagtttcaa 3900 |
| aataaaatat catacaaata ttgagggaaa tgttttcata tttttcaaaa taggttttta 3960 |
| ttgttgaatg tacatctacc ccagcccctc aaaagaaaaa ctgtttacat agaaattcct 4020 |
| acacatacgt ttgcgtatat gttattttaa acatctttgt ggtgagaatt ttttccccga 4080 |
| tattctcctt ctgtcaaagt cagaacaaat tcagggaatt tattttctgg cagttgtgct 4140 |
| ccagtccttt taaaattgta catgaacatg ttttagaaac aatatggagg atgatgcata 4200 |
| catgtcggtc aagttcagcg ctcgacattt tatggaaaga tttttttaac cttaccacga 4260 |
| aatacttaac tactgtttaa gtgaattgac ttatttcact ttagtttttg aactgtgatt 4320 |
| attggtatac tgttatatcc tcaacttgga tttatggtaa ccccttttag ttcatggaga 4380 |
| ccaaaatttg gggtatttat aatagtcagc gcaggaatgc acatggaata tctacttgtc 4440 |
| cttttgaacc tcacgagtca tccagaatgt atagacagga aaagcatgtc ttatttaaaa 4500 |
| ctgtaattta tgggctcagg atctgaccgc agtcccggga gtaagcattt caaaggggga 4560 |
| aggcagtgtg gtccctaccc tgtgtgaatg tgaggatgta gacatccatc agtgcaactc 4620 |
| gagctccatc ctcctccgat ttctaaggct ccagttttct ggagggacag tcatcatgtt 4680 |
| ttgatttatc tgggagaaaa ctgtggtgca cagcttgtga ggagggcaag gttgtgacgt 4740 |
| tcgagcttag ttctggtgtt attctgtctc ctcttctttg tcatcagcca aaacgtggtt 4800 |
| tttaaagaga gtcatgcagg ttagaaataa tgtcaaaaat atttaggaat ttaataacct 4860 |
| ttaagtcaga aactaaaaca aatactgaaa tattagctct tcctacactt cgtgttcccc 4920 |
| tttagctgcc tgaaaatcaa gattgctcct actcagatct tctgagtggc taaaacttat 4980 |
| ggatatgaaa aatgagattg aatgatgact atgctttgct atcattgtta cctttcctca 5040 |
| atactatttg gcaactactg ggactcttca gcacaaaagg aatagatcta tgattgaccc 5100 |
| tgattttaat tgtgaaatta tatgattcat atattttatg aatcagaata accttcaaat 5160 |
| aaaataaatc taagtcggtt aaaatggatt tcatgatttt ccctcagaaa atgagtaacg 5220 |
| gagtccacgg cgtgcaatgg taattataaa ttggtgatgc ttgtttgcaa attgcccact 5280 |
| cgtgataagt caacagccaa tatttaaaac tttgttcgtt actggcttta ccctaacttt 5340 |
| ctctagtcta ctgtcaatat cattttaatg taattgattg tatatagtct caagaatggt 5400 |
| tggtgggcat gagttcctag agaactgtcc aagggttggg aaaatccaaa ttctcttcct 5460 |
| ggctccagca ctgattttgt acataaacat taggcaggtt gcttaacctt tttatttcaa 5520 |
| actctctcaa ctctaaagtg ctaataataa tctcagttac cttatctttg tcacaggtg 5580 |

TABLE LIIb-continued

| Nucleotide sequence of transcript variant 282P1G03 v.3 | |
|---|---|
| ttcttttta tgaagaaaaa tttgaaaatg ataaaagcta agatgccttc taacttcata | 5640 |
| agcaaacctt taactaatta tgtatctgaa agtcaccccc acataccaac tcaacttttt | 5700 |
| tcctgtgaac acataaatat atttttatag aaaaacaaat ctacataaaa taaatctact | 5760 |
| gtttagtgag cagtatgact tgtacatgcc attgaaaatt attaatcaga agaaaattaa | 5820 |
| gcagggtctt tgctatacaa aagtgttttc cactaatttt gcatgcgtat ttataagaaa | 5880 |
| aatgtgaatt tggtggtttt attctatcgg tataaaggca tcgatatttt agatgcaccc | 5940 |
| gtgtttgtaa aaatgtagag cacaatggaa ttatgctgga agtctcaaat aatatttttt | 6000 |
| tcctatttta tactcatgga agagataagc taaagagggg acaataatga gaaatgttgg | 6060 |
| tgtgcttttc taagcattta aaacataatt gccaattgaa accctaaata tgtttacata | 6120 |
| ccattaagat atgattcatg taacaatgtt aaattaatta taatgggatt gggtttgtta | 6180 |
| tctgtggtag tatatatcct agtgttccta tagtgaaata agtagggttc agccaaagct | 6240 |
| ttctttgttt tgtaccttaa attgttcgat tacgtcatca aaagagatga aaggtatgta | 6300 |
| gaacaggttc acgtgattac ctttttcttt tggcttggat taatattcat agtagaactt | 6360 |
| tataaaacgt gtttgtattg taggtggtgt ttgtattatg cttatgacta tgtatggttt | 6420 |
| gaaaatattt tcattataca tgaaattcaa ctttccaaat aaaagttcta cttcatgtaa | 6480 |
| tccaaaa 6487 | |

TABLE LIIIb

| Nucleotide sequence alignment of 282P1G03 v.1 (SEQ ID NO: 158) and 282P1G03 v.3 (SEQ ID NO: 159) | | | |
|---|---|---|---|
| v.1 | 1 | cggaccctgcgcgcccccgtcccggctcccggccggctcgggggagaagg | 50 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 1 | CGGACCCTGCGCGCCCCCGTCCCGGCTCCCGGCCGGCTCGGGGGAGAAGG | 50 |
| v.1 | 51 | cgcccgagggggaggcgccggacagatcgcgtttcggaggcggcgcaggtg | 100 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 51 | CGCCCGAGGGGGAGGCGCCGGACAGATCGCGTTTCGGAGGCGGCGCAGGTG | 100 |
| v.1 | 101 | ctgtaaactgcaaaccataatcctgtcttaatactgcaaacaaatcatag | 150 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 101 | CTGTAAACTGCAAACCATAATCCTGTCTTAATACTGCAAACAAATCATAG | 150 |
| v.1 | 151 | tggaactaaggggaacttaatttactgtttccaggttaactaaggtctca | 200 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 151 | TGGAACTAAGGGGAACTTAATTTACTGTTTCCAGGTTAACTAAGGTCTCA | 200 |
| v.1 | 201 | gctgtaaaccaaaagtgagaggagacattaagattttcattcttaccggg | 250 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 201 | GCTGTAAACCAAAAGTGAGAGGAGACATTAAGATTTTCATTCTTACCGGG | 250 |
| v.1 | 251 | ttgtcttcttcctgaagagcaatggagccgcttttacttggaagaggact | 300 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 251 | TTGTCTTCTTCCTGAAGAGCAATGGAGCCGCTTTTACTTGGAAGAGGACT | 300 |
| v.1 | 301 | aatcgtatatctaatgttcctcctgttaaaattctcaaaagcaattgaaa | 350 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 301 | AATCGTATATCTAATGTTCCTCCTGTTAAAATTCTCAAAAGCAATTGAAA | 350 |
| v.1 | 351 | taccatcttcagttcaacaggttccaacaatcataaaacagtcaaaagtc | 400 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 351 | TACCATCTTCAGTTCAACAGGTTCCAACAATCATAAAACAGTCAAAAGTC | 400 |
| v.1 | 401 | caagttgcctttcccttcgatgagtattttcaaattgaatgtgaagctaa | 450 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.3 | 401 | CAAGTTGCCTTTCCCTTCGATGAGTATTTTCAAATTGAATGTGAAGCTAA | 450 |
| v.1 | 451 | aggaaatccagaaccaacattttcgtggactaaggatggcaaccctttt | 500 |

TABLE LIIIb-continued

Nucleotide sequence alignment of 282P1G03 v.1 (SEQ ID NO: 158) and 282P1G03 v.3 (SEQ ID NO: 159)

```
                ||||||||||||||||||||||||||||||||||||||||||||||||||
v.3   451  AGGAAATCCAGAACCAACATTTTCGTGGACTAAGGATGGCAACCCTTTTT  500

v.1   501  atttcactgaccatcggataattccatcgaacaattcaggaacattcagg  550
           ||||||||||||||||||||||||||||||||||||||||||||||||||
v.3   501  ATTTCACTGACCATCGGATAATTCCATCGAACAATTCAGGAACATTCAGG  550

v.1   551  atcccaaacgaggggcacatatctcactttcaagggaaataccgctgctt  600
           ||||||||||||||||||||||||||||||||||||||||||||||||||
v.3   551  ATCCCAAACGAGGGGCACATATCTCACTTTCAAGGGAAATACCGCTGCTT  600

v.1   601  tgcttcaaataaactgggaatcgctatgtcagaagaaatagaatttatag  650
           ||||||||||||||||||||||||||||||||||||||||||||||||||
v.3   601  TGCTTCAAATAAACTGGGAATCGCTATGTCAGAAGAAATAGAATTTATAG  650

v.1   651  ttccaagtgttccaaaactcccaaaagaaaaaattgaccctctgaagtg   700
           ||||||||||||||||||||||||||||||||||||||||||||||||||
v.3   651  TTCCAAGTGTTCCAAAACTCCCAAAAGAAAAAATTGACCCTCTTGAAGTG  700

v.1   701  gaggagggagatccaattgtcctcccatgcaatcctcccaaaggcctccc  750
           ||||||||||||||||||||||||||||||||||||||||||||||||||
v.3   701  GAGGAGGGAGATCCAATTGTCCTCCCATGCAATCCTCCCAAAGGCCTCCC  750

v.1   751  acctttacacatttattggatgaatattgaattagaacacatcgaacaag  800
           ||||||||||||||||||||||||||||||||||||||||||||||||||
v.3   751  ACCTTTACACATTTATTGGATGAATATTGAATTAGAACACATCGAACAAG  800

v.1   801  atgaaagagtatacatgagccaaaagggagatctatgcttcgcaaacgtg  850
           ||||||||||||||||||||||||||||||||||||||||||||||||||
v.3   801  ATGAAAGAGTATACATGAGCCAAAAGGGAGATCTATACTTCGCAAACGTG  850

v.1   851  gaagaaaaggacagtcgcaatgactactgttgctttgctgcatttccaag  900
           ||||||||||||||||||||||||||||||||||||||||||||||||||
v.3   851  GAAGAAAAGGACAGTCGCAATGACTACTGTTGCTTTGCTGCATTTCCAAG  900

v.1   901  attaaggactattgtacagaaaatgccaatgaaactaacagttaacagtt  950
           ||||||||||||||||||||||||||||||||||||||||||||||||||
v.3   901  ATTAAGGACTATTGTACAGAAAATGCCAATGAAACTAACAGTTAACAGTT  950

v.1   951  taaagcatgctaatgactcaagttcatccacagaaattggttccaaggca  1000
           ||||||||||||||||||||||||||||||||||||||||||||||||||
v.3   951  TAAAGCATGCTAATGACTCAAGTTCATCCACAGAAATTGGTTCCAAGGCA  1000

v.1  1001  aattccatcaagcaaagaaaacccaaactgctgttgcctcccactgagag  1050
           ||||||||||||||||||||||||||||||||||||||||||||||||||
v.3  1001  AATTCCATCAAGCAAAGAAAACCCAAACTGCTGTTGCCTCCCACTGAGAG  1050

v.1  1051  tggcagtgagtcttcaattaccatcctcaaaggggaaatcttgctgcttg  1100
           ||||||||||||||||||||||||||||||||||||||||||||||||||
v.3  1051  TGGCAGTGAGTCTTCAATTACCATCCTCAAAGGGGAAATCTTGCTGCTTG  1100

v.1  1101  agtgttttgctgaaggcttgccaactccacaggttgattggaacaaaatt  1150
           ||||||||||||||||||||||||||||||||||||||||||||||||||
v.3  1101  AGTGTTTTGCTGAAGGCTTGCCAACTCCACAGGTTGATTGGAACAAAATT  1150

v.1  1151  ggtggtgacttaccaaaggggagagaaacaaaagaaaattatggcaagac  1200
           ||||||||||||||||||||||||||||||||||||||||||||||||||
v.3  1151  GGTGGTGACTTACCAAAGGGGAGAGAAACAAAAGAAAATTATGGCAAGAC  1200

v.1  1201  tttgaagatagagaatgtctcctaccaggacaaaggaaattatcgctgca  1250
           ||||||||||||||||||||||||||||||||||||||||||||||||||
v.3  1201  TTTGAAGATAGAGAATGTCTCCTACCAGGACAAAGGAAATTATCGCTGCA  1250

v.1  1251  cagccagcaatttcttgggaacagccactcacgattttcacgttatagta  1300
           ||||||||||||||||||||||||||||||||||||||||||||||||||
v.3  1251  CAGCCAGCAATTTCTTGGGAACAGCCACTCACGATTTTCACGTTATAGTA  1300

v.1  1301  gaagagcctcctcgctggacaaagaagcctcagagtgctgtgtatagcac  1350
           ||||||||||||||||||||||||||||||||||||||||||||||||||
v.3  1301  GAAGAGCCTCCTCGCTGGACAAAGAAGCCTCAGAGTGCTGTGTATAGCAC  1350

v.1  1351  cggaagcaatggcatcttgttatgtgaggctgaaggagaacctcaaccca  1400
           ||||||||||||||||||||||||||||||||||||||||||||||||||
v.3  1351  CGGAAGCAATGGCATCTTGTTATGTGAGGCTGAAGGAGAACCTCAACCCA  1400

v.1  1401  caatcaagtggagagtcgatggctccccagttgacaatcatccatttgct  1450
```

TABLE LIIIb-continued

Nucleotide sequence alignment of 282P1G03 v.1 (SEQ ID NO: 158) and 282P1G03 v.3 (SEQ ID NO: 159)

```
                ||||||||||||||||||||||||||||||||||||||||||||||||||
v.3  1401  CAATCAAGTGGAGAGTCAATGGCTCCCCAGTTGACAATCATCCATTTGCT  1450

v.1  1451  ggtgatgttgtcttccccagggaaatcagttttaccaaccttcaaccaaa  1500
           ||||||||||||||||||||||||||||||||||||||||||||||||||
v.3  1451  GGTGATGTTGTCTTCCCCAGGGAAATCAGTTTTACCAACCTTCAACCAAA  1500

v.1  1501  tcatactgctgtgtaccagtgtgaagcctcaaatgtccatggaactatcc  1550
           ||||||||||||||||||||||||||||||||||||||||||||||||||
v.3  1501  TCATACTGCTGTGTACCAGTGTGAAGCCTCAAATGTCCATGGAACTATCC  1550

v.1  1551  ttgccaatgccaatattgatgttgtggatgtccgtccattgatacaaacc  1600
           ||||||||||||||||||||||||||||||||||||||||||||||||||
v.3  1551  TTGCCAATGCCAATATTGATGTTGTGGATGTCCGTCCATTGATACAAACC  1600

v.1  1601  aaagatggagaaaattacgctacagtggttgggtacagtgctttcttaca  1650
           ||||||||||||||||||||||||||||||||||||||||||||||||||
v.3  1601  AAAGATGGAGAAAATTACGCTACAGTGGTTGGGTACAGTGCTTTCTTACA  1650

v.1  1651  ttgcgagttctttgcttcacctgaggcagtcgtgtcctggcagaaggtgg  1700
           ||||||||||||||||||||||||||||||||||||||||||||||||||
v.3  1651  TTGCGAGTTCTTTGCTTCACCTGAGGCAGTCGTGTCCTGGCAGAAGGTGG  1700

v.1  1701  aagaagtgaaacccctggagggcaggcggtatcatatctatgaaaatggc  1750
           ||||||||||||||||||||||||||||||||||||||||||||||||||
v.3  1701  AAGAAGTGAAACCCCTGGAGGGCAGGCGGTATCATATCTATGAAAATGGC  1750

v.1  1751  acattgcagatcaacagaaccaccgaagaagatgctgggtcttgctcatg  1800
           ||||||||||||||||||||||||||||||||||||||||||||||||||
v.3  1751  ACATTGCAGATCAACAGAACCACCGAAGAAGATGCTGGGTCTTACTCATG  1800

v.1  1801  ttgggtagaaaatgctataggaaaaactgcagtcacagccaatttggata  1850
           ||||||||||||||||||||||||||||||||||||||||||||||||||
v.3  1801  TTGGGTAGAAAATGCTATAGGAAAAACTGCAGTCACAGCCAATTTGGATA  1850

v.1  1851  ttagaaatgctacaaaacttagagtttctcctaagaatcctcgtatcccc  1900
           ||||||||||||||||||||||||||||||||||||||||||||||||||
v.3  1851  TTAGAAATGCTACAAAACTTAGAGTTTCTCCTAAGAATCCTCGTATCCCC  1900

v.1  1901  aaattgcatatgcttgaattacattgtgaaagcaaatgtgactcacattt  1950
           ||||||||||||||||||||||||||||||||||||||||||||||||||
v.3  1901  AAATTGCATATGCTTGAATTACATTGTGAAAGCAAATGTGACTCACATTT  1950

v.1  1951  gaaacacagtttgaagttgtcctggagtaaagatggagaagcctttgaaa  2000
           ||||||||||||||||||||||||||||||||||||||||||||||||||
v.3  1951  GAAACACAGTTTGAAGTTGTCCTGGAGTAAAGATGGAGAAGCCTTTGAAA  2000

v.1  2001  ttaatggcacagaagatggcaggataattattgatggagctaatttgacc  2050
           ||||||||||||||||||||||||||||||||||||||||||||||||||
v.3  2001  TTAATGGCACAGAAGATGGCAGGATAATTATTGATGGAGCTAATTTGACC  2050

v.1  2051  atatctaatgtaactttagaggaccaaggtatttactgctgttcagctca  2100
           ||||||||||||||||||||||||||||||||||||||||||||||||||
v.3  2051  ATATCTAATGTAACTTTAGAGGACCAAGGTATTTACTGCTGTTCAGCTCA  2100

v.1  2101  tactgctctagacagtgctgccgatataactcaagtaactgttcttgatg  2150
           ||||||||||||||||||||||||||||||||||||||||||||||||||
v.3  2101  TACTGCTCTAGACAGTGCTGCCGATATAACTCAAGTAACTGTTCTTGATG  2150

v.1  2151  ttccggatccaccagaaaaccttcacttgtctgaaagacagaacaggagt  2200
           ||||||||||||||||||||||||||||||||||||||||||||||||||
v.3  2151  TTCCGGATCCACCAGAAAACCTTCACTTGTCTGAAAGACAGAACAGGAGT  2200

v.1  2201  gttcggctgacctgggaagctggagctgaccacaacagcaatattagcga  2250
           ||||||||||||||||||||||||||||||||||||||||||||||||||
v.3  2201  GTTCGGCTGACCTGGGAAGCTGGAGCTGACCACAACAGCAATATTAGCGA  2250

v.1  2251  gtatattgttgaatttgaaggaaacaaagaagagcctggaaggtgggagg  2300
           ||||||||||||||||||||||||||||||||||||||||||||||||||
v.3  2251  GTATATTGTTGAATTTGAAGGAAACAAAGAAGAGCCTGGAAGGTGGGAGG  2300

v.1  2301  aactgaccagagtccaaggaaagaaaaccacagttatcttacctttgtgct 2350
           ||||||||||||||||||||||||||||||||||||||||||||||||||
v.3  2301  AACTCACCAGAGTCCAAGGAAAGAAAACCACAGTTATCTTACCTTTGGCT  2350

v.1  2351  ccatttgtgagataccagttcagggtcatagccgtgaacgaagtagggag  2400
```

TABLE LIIIb-continued

Nucleotide seguence alignment of 282P1G03 v.1 (SEQ ID NO: 158) and 282P1G03 v.3 (SEQ ID NO: 159)

```
               ||||||||||||||||||||||||||||||||||||||||||||||||||
v.3  2351  CCATTTGTGAGATACCAGTTCAGGGTCATAGCCGTGAACGAAGTAGGGAG  2400

v.1  2401  aagtcagcctagccagccgtcagaccatcatgaaacaccaccagcagctc  2450
           ||||||||||||||||||||||||||||||||||||||||||||||||||
v.3  2401  AAGTCAGCCTAGCCAGCCGTCAGACCATCATGAAACACCACCAGCAGCTC  2450

v.1  2451  cagataggaatccacaaaacataagggttcaagcctctcaacccaaggaa  2500
           ||||||||||||||||||||||||||||||||||||||||||||||||||
v.3  2451  CAGATAGGAATCCACAAAACATAAGGGTTCAAGCCTCTCAACCCAAGGAA  2500

v.1  2501  atgattataaagtgggagcctttgaaatccatggagcagaatggaccagg  2550
           ||||||||||||||||||||||||||||||||||||||||||||||||||
v.3  2501  ATGATTATAAAGTGGGAGCCTTTGAAATCCATGGAGCAGAATGGACCAGG  2550

v.1  2551  cctagagtacagagtgacctggaagccacagggagccccagtggagtggg  2600
           ||||||||||||||||||||||||||||||||||||||||||||||||||
v.3  2551  CCTAGAGTACAGAGTGACCTGGAAGCCACAGGGAGCCCCAGTGGAGTGGG  2600

v.1  2601  aagaagaaacagtcacaaaccacacattgcgggtgatgacgcctgctgtc  2650
           ||||||||||||||||||||||||||||||||||||||||||||||||||
v.3  2601  AAGAAGAAACAGTCACAAACCACACATTGCGGGTGATGACGCCTGCTGTC  2650

v.1  2651  tatgccccttatgatgtcaaggtccaggctatcaatcaactaggatctgg  2700
           ||||||||||||||||||||||||||||||||||||||||||||||||||
v.3  2651  TATGCCCCTTATGATGTCAAGGTCCAGGCTATCAATCAACTAGGATCTGG  2700

v.1  2701  gcctgaccctcagtcagtgactctctattctggagaagactatcctgata  2750
           ||||||||||||||||||||||||||||||||||||||||||||||||||
v.3  2701  GCCTGACCCTCAGTCAGTGACTCTCTATTCTGGAGAAGACTATCCTGATA  2750

v.1  2751  cagctccagtgatccatggggtggacgttataaacagtacattagttaaa  2800
           ||||||||||||||||||||||||||||......................
v.3  2751  CAGCTCCAGTGATCCATGGGGTGGACGTT---------------------  2779

v.1  2801  gttacctggtcaacagttccaaaggacagagtacatggacgtctgaaagg  2850

v.3  2780  --------------------------------------------------  2779

v.1  2851  ctatcagataaattggtggaaaacaaaaagtctgttggatggaagaacac  2900

v.3  2780  --------------------------------------------------  2779

v.1  2901  atcccaaagaagtgaacattctaagattttcaggacaaagaaactctgga  2950

v.3  2780  --------------------------------------------------  2779

v.1  2951  atggttccttccttagatgcctttagtgaatttcatttaacagtcttagc  3000

v.3  2780  --------------------------------------------------  2779

v.1  3001  ctataactctaaaggagctggtcctgaaagtgagccttatatatttcaaa  3050

v.3  2780  --------------------------------------------------  2779

v.1  3051  caccagaaggagtacctgaacagccaacttttctaaaggtcatcaaagtt  3100

v.3  2780  --------------------------------------------------  2779

v.1  3101  gataaagacactgccactttatcttggggactacctaagaaattaaatgg  3150

v.3  2780  --------------------------------------------------  2779

v.1  3151  aaacttaactggctatcttttgcaatatcagataataaatgacacctacg  3200

v.3  2780  --------------------------------------------------  2779

v.1  3201  agattggagaattaaatgatattaacattacaactccatcaaagcccagc  3250

v.3  2780  --------------------------------------------------  2779

v.1  3251  tggcacctctcaaacctgaatgcaactaccaagtacaaattctacttgag  3300

v.3  2780  --------------------------------------------------  2779

v.1  3301  ggcttgcacttcacagggctgtggaaaaccgatcacggaggaaagctcca  3350
```

TABLE LIIIb-continued

Nucleotide sequence alignment of 282P1G03 v.1 (SEQ ID NO: 158) and 282P1G03 v.3 (SEQ ID NO: 159)

```
v.3  2780  --------------------------------------------------  2779

v.1  3351  ccttaggagaagggagtaaaggtatcgggaagatatcaggagtaaatctt  3400

v.3  2780  --------------------------------------------------  2779

v.1  3401  actcaaaagactcacccaatagaggtatttgagccgggagctgaacatat  3450

v.3  2780  --------------------------------------------------  2779

v.1  3451  agttcgcctaatgactaagaattggggcgataacgatagcatttttcaag  3500

v.3  2780  --------------------------------------------------  2779

v.1  3501  atgtaattgagacaagagggagagaatatgctggtttatatgatgacatc  3550

v.3  2780  --------------------------------------------------  2779

v.1  3551  tccactcaaggctggtttattggactgatgtgtgcgattgctcttctcac  3600

v.3  2780  --------------------------------------------------  2779

v.1  3601  actactattattaactgtttgctttgtgaagaggaatagaggtggaaagt  3650

v.3  2780  --------------------------------------------------  2779

v.1  3651  actcagttaaagaaaaggaagatttgcatccagacccagaaattcagtca  3700

v.3  2780  --------------------------------------------------  2779

v.1  3701  gtaaaagatgaaacctttggtgaatacagtgacagtgatgaaaagcctct  3750

v.3  2780  --------------------------------------------------  2779

v.1  3751  caaaggaagccttcggtcccttaatagggatatgcagcctactgaaagtg  3800

v.3  2780  --------------------------------------------------  2779

v.1  3801  ctgacagcttagtcgaatacggagagggagaccatggtctcttcagtgaa  3850

v.3  2780  --------------------------------------------------  2779

v.1  3851  gatggatcatttattggtgcctacgctggatctaaggagaagggatctgt  3900

v.3  2780  --------------------------------------------------  2779

v.1  3901  tgaaagcaatggaagttctacagcaacttttccccttcgggcataaacac  3950
                                                     ||||||||
v.3  2780  ------------------------------------------ATAAACAC  2787

v.1  3951  aacatatgtaagcaacgctactggttcaccccaaccttccatatttatct  4000
           ||||||||||||||||||||||||||||||||||||||||||||||||||
v.3  2788  AACATATGTAAGCAACGCTACTGGTTCACCCCAACCTTCCATATTTATCT  2837

v.1  4001  gttcaaaggagcaagaactttcatataggaatagaaacatgctggccgaa  4050
           ||||||||||||||||||||||||||||||||||||||||||||||||||
v.3  2838  GTTCAAAGGAGCAAGAACTTTCATATAGGAATAGAAACATGCTGGCCGAA  2887

v.1  4051  gatttcatccagaagtcaacatcctgcaattatgttgaaaagagtagtac  4100
           ||||||||||||||||||||||||||||||||||||||||||||||||||
v.3  2888  GATTTCATCCAGAAGTCAACATCCTGCAATTATGTTGAAAAGAGTAGTAC  2937

v.1  4101  tttcttcaaaatataaaatgccaagcacttcaggcctatgttttgcttat  4150
           ||||||||||||||||||||||||||||||||||||||||||||||||||
v.3  2938  TTTCTTCAAAATATAAAATGCCAAGCACTTCAGGCCTATGTTTTGCTTAT  2987

v.1  4151  attgttttcaggtgctcaaaatgcaaaacacaaaacaaatcctgcattta  4200
           ||||||||||||||||||||||||||||||||||||||||||||||||||
v.3  2988  ATTGTTTTCAGGTGCTCAAAATGCAAAACACAAAACAAATCCTGCATTTA  3037

v.1  4201  gatacacctcaactaaatccaaagtccccattcagtatattccatatttg  4250
           ||||||||||||||||||||||||||||||||||||||||||||||||||
v.3  3038  GATACACCTCAACTAAATCCAAAGTCCCCATTCAGTATATTCCATATTTG  3087

v.1  4251  cctgattttactattcggtgtgtttgcatagatgttgctacttggtgggt  4300
```

TABLE LIIIb-continued

Nucleotide sequence alignment of 282P1G03 v.1 (SEQ ID NO: 158) and 282P1G03 v.3 (SEQ ID NO: 159)

```
                ||||||||||||||||||||||||||||||||||||||||||||||||||
v.3  3088  CCTGATTTTACTATTCGGTGTGTTTGCATAGATGTTGCTACTTGGTGGGT  3137

v.1  4301  ttttctccgtatgcacattggtatacagtctctgagaactggcttggtga  4350
           ||||||||||||||||||||||||||||||||||||||||||||||||||
v.3  3138  TTTTCTCCGTATGCACATTGGTATACAGTCTCTGAGAACTGGCTTGGTGA  3187

v.1  4351  ctttgcttcactacaggttaaaagaccataagcaaactggttatttaaaa  4400
           ||||||||||||||||||||||||||||||||||||||||||||||||||
v.3  3188  CTTTGCTTCACTACAGGTTAAAAGACCATAAGCAAACTGGTTATTTAAAA  3237

v.1  4401  tgtaaaaaggaatatgaaagtcttattaaaacacttcattgaaaatatac  4450
           ||||||||||||||||||||||||||||||||||||||||||||||||||
v.3  3238  TGTAAAAAGGAATATGAAAGTCTTATTAAAACACTTCATTGAAAATATAC  3287

v.1  4451  agtctaaatttattatttaaattttactagcaaaagtcttaggtgaacaa  4500
           ||||||||||||||||||||||||||||||||||||||||||||||||||
v.3  3288  AGTCTAAATTTATTATTTAAATTTTACTAGCAAAAGTCTTAGGTGAACAA  3337

v.1  4501  tcaactagtatttgttgagctcctatttgcccagagatggtcatatttaa  4550
           ||||||||||||||||||||||||||||||||||||||||||||||||||
v.3  3338  TCAACTAGTATTTGTTGAGCTCCTATTTGCCCAGAGATGGTCATATTTAA  3387

v.1  4551  acagaagtatacgtttttcagtttcaacatgaatttttttatttctgtca  4600
           ||||||||||||||||||||||||||||||||||||||||||||||||||
v.3  3388  ACAGAAGTATACGTTTTTCAGTTTCAACATGAATTTTTTTATTTCTGTCA  3437

v.1  4601  gttatgacatccacgagcatcacttttttgtgtctgtttttttttttttct  4650
           ||||||||||||||||||||||||||||||||||||||||||||||||||
v.3  3438  GTTATGACATCCACgAGCATCACTTTTTGTGTCTGTTTTTTTTTTTTTCT  3487

v.1  4651  tggactaaattcaactgcatggaagcggtggtcagaaggttgttttatac  4700
           ||||||||||||||||||||||||||||||||||||||||||||||||||
v.3  3488  TGGACTAAATTCAACTGCATGGAAGCGGTGGTCAGAAGGTTGTTTTATAC  3537

v.1  4701  gagaacaggcagaaagtgcccattgttcaggattctaatagctacatcta  4750
           ||||||||||||||||||||||||||||||||||||||||||||||||||
v.3  3538  GAGAACAGGCAGAAAGTGCCCATTGTTCAGGATTCTAATAGCTACATCTA  3587

v.1  4751  cttaatatcttcatttctaaattgactgcttttaccttttttctcatgttt  4800
           ||||||||||||||||||||||||||||||||||||||||||||||||||
v.3  3588  CTTAATATCTTCATTTCTAAATTGACTGCTTTTACCTTTTTCTCATGTTT  3637

v.1  4801  atataatggtatgcttgcatatatttcatgaatacattgtacatattatg  4850
           ||||||||||||||||||||||||||||||||||||||||||||||||||
v.3  3638  ATATAATGGTATGCTTGCATATATTTCATGAATACATTGTACATATTATG  3687

v.1  4851  ttaatatttacacaatttaaaatatagatgtgttttattttgaagtgaga  4900
           ||||||||||||||||||||||||||||||||||||||||||||||||||
v.3  3688  TTAATATTTACACAATTTAAAATATAGATGTGTTTTATTTTGAAGTGAGA  3737

v.1  4901  aaatgaacattaacaggcatgtttgtacagctagaatatattagtaagat  4950
           ||||||||||||||||||||||||||||||||||||||||||||||||||
v.3  3738  AAATGAACATTAACAGGCATGTTTGTACAGCTAGAATATATTAGTAAGAT  3787

v.1  4951  actgtttttcgtcattccagagctacaactaataacacgaggttccaaag  5000
           ||||||||||||||||||||||||||||||||||||||||||||||||||
v.3  3788  ACTGTTTTTCGTCATTCCAGAGCTACAACTAATAACACGAGGTTCCAAAG  3837

v.1  5001  ctgaagactttgtataaagtatttgggttttgttcttgtattgctttctt  5050
           ||||||||||||||||||||||||||||||||||||||||||||||||||
v.3  3838  CTGAAGACTTTGTATAAAGTATTTGGGTTTTGTTCTTGTATTGCTTTCTT  3887

v.1  5051  tcaacagtttcaaaataaaatatcatacaaatattgagggaaatgttttc  5100
           ||||||||||||||||||||||||||||||||||||||||||||||||||
v.3  3888  TCAACAGTTTCAAAATAAAATATCATACAAATATTGAGGGAAATGTTTTC  3937

v.1  5101  atatttttcaaaataggtttttattgttgaatgtacatctaccccagccc  5150
           ||||||||||||||||||||||||||||||||||||||||||||||||||
v.3  3938  ATATTTTTCAAAATAGGTTTTTATTGTTGAATGTACATCTACCCCAGCCC  3987

v.1  5151  ctcaaaagaaaaactgtttacatagaaattcctacacatacgtttgcgta  5200
           ||||||||||||||||||||||||||||||||||||||||||||||||||
v.3  3988  CTCAAAAGAAAAACTGTTTACATAGAAATTCCTACACATACGTTTGCGTA  4037

v.1  5201  tatgttattttaaacatctttgtggtgagaatttttttccccgatattctc  5250
```

TABLE LIIIb-continued

Nucleotide seguence alignment of 282P1G03 v.1 (SEQ ID NO: 158) and 282P1G03 v.3 (SEQ ID NO: 159)

```
                ||||||||||||||||||||||||||||||||||||||||||||||||||
v.3  4038  TATGTTATTTTAAACATCTTTGTGGTGAGAATTTTTTCCCCGATATTCTC  4087

v.1  5251  cttctgtcaaagtcagaacaaattcagggaatttattttctggcagttgt  5300
           ||||||||||||||||||||||||||||||||||||||||||||||||||
v.3  4088  CTTCTGTCAAAGTCAGAACAAATTCAGGGAATTTATTTTCTGGCAGTTGT  4137

v.1  5301  gctccagtccttttaaaattgtacatgaacatgttttagaaacaatatgg  5350
           ||||||||||||||||||||||||||||||||||||||||||||||||||
v.3  4138  GCTCCAGTCCTTTTAAAATTGTACATGAACATGTTTTAGAAACAATATGG  4187

v.1  5351  aggatgatgcatacatgtcggtcaagttcagcgctcgacattttatggaa  5400
           ||||||||||||||||||||||||||||||||||||||||||||||||||
v.3  4188  AGGATGATGCATACATGTCGGTCAAGTTCAGCGCTCGACATTTTATGGAA  4237

v.1  5401  agatttttttaaccttaccacgaaatacttaactactgtttaagtgaatt  5450
           ||||||||||||||||||||||||||||||||||||||||||||||||||
v.3  4238  AGATTTTTTTAACCTTACCACGAAATACTTAACTACTGTTTAAGTGAATT  4287

v.1  5451  gacttatttcactttagtttttgaactgtgattattggtatactgttata  5500
           ||||||||||||||||||||||||||||||||||||||||||||||||||
v.3  4288  GACTTATTTCACTTTAGTTTTTGAACTGTGATTATTGGTATACTGTTATA  4337

v.1  5501  tcctcaacttggatttatggtaacccctttttagttcatggagaccaaaat  5550
           ||||||||||||||||||||||||||||||||||||||||||||||||||
v.3  4338  TCCTCAACTTGGATTTATGGTAACCCCTTtTAGTTCATGGAGACCAAAAT  4387

v.1  5551  ttggggtatttataatagtcagcgcaggaatgcacatggaatatctactt  5600
           ||||||||||||||||||||||||||||||||||||||||||||||||||
v.3  4388  TTGGGGTATTTATAATAGTCAGCGCAGGAATGCACATGGAATATCTACTT  4437

v.1  5601  gtccttttgaacctcacgagtcatccagaatgtatagacaggaaaagcat  5650
           ||||||||||||||||||||||||||||||||||||||||||||||||||
v.3  4438  GTCCTTTTGAACCTCACGAGTCATCCAGAATGTATAGACAGGAAAAGCAT  4487

v.1  5651  gtcttatttaaaactgtaatttatgggctcaggatctgaccgcagtcccg  5700
           ||||||||||||||||||||||||||||||||||||||||||||||||||
v.3  4488  GTCTTATTTAAAACTGTAATTTATGGGCTCAGGATCTGACCGCAGTCCCG  4537

v.1  5701  ggagtaagcatttcaaagggggaaggcagtgtggtccctaccctgtgtga  5750
           ||||||||||||||||||||||||||||||||||||||||||||||||||
v.3  4538  GGAGTAAGCATTTCAAAGGGGGAAGGCAGTGTGGTCCCTACCCTGTGTGA  4587

v.1  5751  atgtgaggatgtagacatccatcagtgcaactcgagctccatcctcctcc  5800
           ||||||||||||||||||||||||||||||||||||||||||||||||||
v.3  4588  ATGTGAGGATGTAGACATCCATCAGTGCAACTCGAGCTCCATCCTCCTCC  4637

v.1  5801  gatttctaaggctccagttttctggagggacagtcatcatgttttgattt  5850
           ||||||||||||||||||||||||||||||||||||||||||||||||||
v.3  4638  GATTTCTAAGGcTCCAGTTTTCTGGAGGGACAGTCATCATGTTTTGATTT  4687

v.1  5851  atctgggagaaaactgtggtgcacagcttgtgaggagggcaaggttgtga  5900
           ||||||||||||||||||||||||||||||||||||||||||||||||||
v.3  4688  ATCTGGGAGAAAACTGTGGTGCACAGCTTGTGAGGAGGGCAAGGTTGTGA  4737

v.1  5901  cgttcgagcttagttctggtgttattctgtctcctcttctttgtcatcag  5950
           ||||||||||||||||||||||||||||||||||||||||||||||||||
v.3  4738  CGTTCGAGCTTAGTTCTGGTGTTATTCTGTCTCCTCTTCTTTGTCATCAG  4787

v.1  5951  ccaaaacgtggtttttaaagagagtcatgcaggttagaaataatgtcaaa  6000
           ||||||||||||||||||||||||||||||||||||||||||||||||||
v.3  4788  CCAAAACGTGGTTTTTAAAGAGAGTCATGCAGGTTAGAAATAATGTCAAA  4837

v.1  6001  aatatttaggaatttaataacctttaagtcagaaactaaaacaaatactg  6050
           ||||||||||||||||||||||||||||||||||||||||||||||||||
v.3  4838  AATATTTAGGAATTTAATAACCTTTAAGTCAGAAACTAAAACAAATACTG  4887

v.1  6051  aaatattagctcttcctacacttcgtgttcccctttagctgcctgaaaat  6100
           ||||||||||||||||||||||||||||||||||||||||||||||||||
v.3  4888  AAATATTAGCTCTTCCTACACTTCGTGTTCCCCTTTAGCTGCCTGAAAAT  4937

v.1  6101  caagattgctcctactcagatcttctgagtggctaaaacttatggatatg  6150
           ||||||||||||||||||||||||||||||||||||||||||||||||||
v.3  4938  CAAGATTGCTCCTaCTCAGATCTTCTGAGTGGCTAAAACTTATGGATATG  4987

v.1  6151  aaaaatgagattgaatgatgactatgctttgctatcattgttacctttcc  6200
```

TABLE LIIIb-continued

Nucleotide seguence alignment of 282P1G03 v.1 (SEQ ID NO: 158) and 282P1G03 v.3 (SEQ ID NO: 159)

```
              ||||||||||||||||||||||||||||||||||||||||||||||||||
v.3  4988  AAAAATGAGATTGAATGATGACTATGCTTTGCTATCATTGTTACCTTTCC  5037

v.1  6201  tcaatactatttggcaactactgggactcttcagcacaaaaggaatagat  6250
           ||||||||||||||||||||||||||||||||||||||||||||||||||
v.3  5038  TCAATACTATTTGGCAACTACTGGGACTCTTCAGCACAAAAGGAATAGAT  5087

v.1  6251  ctatgattgaccctgattttaattgtgaaattatatgattcatatatttt  6300
           ||||||||||||||||||||||||||||||||||||||||||||||||||
v.3  5088  CTATGATTGACCCTGATTTTAATTGTGAAATTATATGATTCATATATTTT  5137

v.1  6301  atgaatcagaataaccttcaaataaaataaatctaagtcggttaaaatgg  6350
           ||||||||||||||||||||||||||||||||||||||||||||||||||
v.3  5138  ATGAATCAGAATAACCTTCAAATAAAATAAATCTAAGTCGGTTAAAATGG  5187

v.1  6351  atttcatgattttccctcagaaaatgagtaacggagtccacggcgtgcaa  6400
           ||||||||||||||||||||||||||||||||||||||||||||||||||
v.3  5188  ATTTCATGATTTTCCCTCAGAAAATGAGTAACgGAGTCCACGGCGTGCAA  5237

v.1  6401  tggtaattataaattggtgatgcttgtttgcaaattgcccactcgtgata  6450
           ||||||||||||||||||||||||||||||||||||||||||||||||||
v.3  5238  TGGTAATTATAAATTGGTGATGCTTGTTTGCAAATTGCCCACTCGTGATA  5287

v.1  6451  agtcaacagccaatatttaaaactttgttcgttactggctttaccctaac  6500
           ||||||||||||||||||||||||||||||||||||||||||||||||||
v.3  5288  AGTCAACAGCCAATATTTAAAACTTTGTTCGTTACTGGCTTTACCCTAAC  5337

v.1  6501  tttctctagtctactgtcaatatcattttaatgtaattgattgtatatag  6550
           ||||||||||||||||||||||||||||||||||||||||||||||||||
v.3  5338  TTTCTCTAGTCTACTGTCAATATCATTTTAATGTAATTGATTGTATATAG  5387

v.1  6551  tctcaagaatggttggtgggcatgagttcctagagaactgtccaagggtt  6600
           ||||||||||||||||||||||||||||||||||||||||||||||||||
v.3  5388  TCTCAAGAATGGTTGGTGGGCATGAGTTCCTAGAGAACTGTCCAAGGGTT  5437

v.1  6601  gggaaaatccaaattctcttcctggctccagcactgattttgtacataaa  6650
           ||||||||||||||||||||||||||||||||||||||||||||||||||
v.3  5438  GGGAAAATCCAAATTCTCTTCCTGGcTCCAGCACTGATTTTGTACATAAA  5487

v.1  6651  cattaggcaggttgcttaaccttttttatttcaaactctctcaactctaaa  6700
           ||||||||||||||||||||||||||||||||||||||||||||||||||
v.3  5488  CATTAGGCAGGTTGCTTAACCTTTTTATTTCAAACTCTCTCAACTCTAAA  5537

v.1  6701  gtgctaataataatctcagttaccttatctttgtcacagggtgttctttt  6750
           ||||||||||||||||||||||||||||||||||||||||||||||||||
v.3  5538  GTGCTAATAATAATCTCAGTTACCTTATCTTTGTCACAGGGTGTTCTTTT  5587

v.1  6751  ttatgaagaaaaatttgaaaatgataaaagctaagatgccttctaacttc  6800
           ||||||||||||||||||||||||||||||||||||||||||||||||||
v.3  5588  TTATGAAGAAAAATTTGAAAATGATAAAAGCTAAGATGCCTTCTAACTTC  5637

v.1  6801  ataagcaaacctttaactaattatgtatctgaaagtcacccccacatacc  6850
           ||||||||||||||||||||||||||||||||||||||||||||||||||
v.3  5638  ATAAGCAAACCTTTAACTAATTATGTATCTGAAAGTCACCCCCACATACC  5687

v.1  6851  aactcaactttttttcctgtgaacacataaatatatttttatagaaaaaca  6900
           ||||||||||||||||||||||||||||||||||||||||||||||||||
v.3  5688  AACTCAACTTTTTTCCTGTGAACACATAAATATATTTTTATAGAAAAACA  5737

v.1  6901  aatctacataaaataaatctactgtttagtgagcagtatgacttgtacat  6950
           ||||||||||||||||||||||||||||||||||||||||||||||||||
v.3  5738  AATCTACATAAAATAAATCTACTGTTTAGTGAGCAGTATGACTTGTACAT  5787

v.1  6951  gccattgaaaattattaatcagaagaaaattaagcagggtctttgctata  7000
           ||||||||||||||||||||||||||||||||||||||||||||||||||
v.3  5788  GCCATTGAAAATTATTAATCAGAAGAAAATTAAGCAGGGTCTTTGCTATA  5837

v.1  7001  caaaagtgttttccactaattttgcatgcgtatttataagaaaaatgtga  7050
           ||||||||||||||||||||||||||||||||||||||||||||||||||
v.3  5838  CAAAAGTGTTTTCCACTAATTTTGCATGCGTATTTATAAGAAAAATGTGA  5887

v.1  7051  atttggtggttttattctatcggtataaaggcatcgatattttagatgca  7100
           ||||||||||||||||||||||||||||||||||||||||||||||||||
v.3  5888  ATTTGGTGGTTTTATTCTATCGGTATAAAGGCATCGATATTTTAGATGCA  5937

v.1  7101  cccgtgtttgtaaaaatgtagagcacaatggaattatgctggaagtctca  7150
```

TABLE LIIIb-continued

Nucleotide sequence alignment of 282P1G03 v.1 (SEQ ID NO: 158) and 282P1G03 v.3 (SEQ ID NO: 159)

```
          ||||||||||||||||||||||||||||||||||||||||||||||||||
v.3  5938 CCCGTGTTTGTAAAAATGTAGAGCACAATGGAATTATGCTGGAAGTCTCA 5987

v.1  7151 aataatattttttcctattttatactcatggaagagataagctaaagag 7200
          ||||||||||||||||||||||||||||||||||||||||||||||||||
v.3  5988 AATAATATTTTTTCCTATTTTATACTCATGGAAGAGATAAGCTAAAGAG 6037

v.1  7201 gggacaataatgagaaatgttggtgtgcttttctaagcatttaaaacata 7250
          ||||||||||||||||||||||||||||||||||||||||||||||||||
v.3  6038 GGGACAATAATGAGAAATGTTGGTGTGCTTTTCTAAGCATTTAAAACATA 6087

v.1  7251 attgccaattgaaaccctaaatatgtttacataccattaagatatgattc 7300
          ||||||||||||||||||||||||||||||||||||||||||||||||||
v.3  6088 ATTGCCAATTGAAACCCTAAATATGTTTACATACCATTAAGATATGATTC 6137

v.1  7301 atgtaacaatgttaaattaattataatgggattgggtttgttatctgtgg 7350
          ||||||||||||||||||||||||||||||||||||||||||||||||||
v.3  6138 ATGTAACAATGTTAAATTAATTATAATGGGATTGGGTTTGTTATCTGTGG 6187

v.1  7351 tagtatatatcctagtgttcctatagtgaaataagtagggttcagccaaa 7400
          ||||||||||||||||||||||||||||||||||||||||||||||||||
v.3  6188 TAGTATATATCCTAGTGTTCCTATAGTGAAATAAGTAGGGTTCAGCCAAA 6237

v.1  7401 gctttctttgttttgtaccttaaattgttcgattacgtcatcaaaagaga 7450
          ||||||||||||||||||||||||||||||||||||||||||||||||||
v.3  6238 GCTTTCTTTGTTTTGTACCTTAAATTGTTCGATTACGTCATCAAAAGAGA 6287

v.1  7451 tgaaaggtatgtagaacaggttcacgtgattaccttttttcttttggcttg 7500
          ||||||||||||||||||||||||||||||||||||||||||||||||||
v.3  6288 TGAAAGGTATGTAGAACAGGTTCACGTGATTACCTTTTTCTTTTGGCTTG 6337

v.1  7501 gattaatattcatagtagaactttataaaacgtgtttgtattgtaggtgg 7550
          ||||||||||||||||||||||||||||||||||||||||||||||||||
v.3  6338 GATTAATATTCATAGTAGAACTTTATAAAACGTGTTTGTATTGTAGGTGG 6387

v.1  7551 tgtttgtattatgcttatgactatgtatggtttgaaaatattttcattat 7600
          ||||||||||||||||||||||||||||||||||||||||||||||||||
v.3  6388 TGTTTGTATTATGCTTATGACTATGTATGGTTTGAAAATATTTTCATTAT 6437

v.1  7601 acatgaaattcaactttccaaataaaagttctacttcatgtaatccaaaa 7650
          ||||||||||||||||||||||||||||||||||||||||||||||||||
v.3  6438 ACATGAAATTCAACTTTCCAAATAAAAGTTCTACTTCATGTAATCCAAAA 6487
```

TABLE LIVb

Peptide sequences of protein coded by 282P1G03 v.3

```
                                                       (SEQ ID NO:160)
MEPLLLGRGL IVYLMFLLLK FSKAIEIPSS VQQVPTIIKQ SKVQVAFPFD EYFQIECEAK  60

GNPEPTFSWT KDGNPFYFTD HRIIPSNNSG TFRIPNEGHI SHFQGKYRCF ASNKLGIAMS 120

EEIEFIVPSV PKLPKEKIDP LEVEEGDPIV LPCNPPKGLP PLHIYWMNIE LEHIEQDERV 180

YMSQKGDLYF ANVEEKDSRN DYCCFAAFPR LRTIVQKMPM KLTVHSLKHA NDSSSSTEIG 240

SKANSIKQRK PKLLLPPTES GSESSITILK GEILLLECFA EGLPTPQVDW NKIGGDLPKG 300

RETKENYGKT LKIENVSYQD KGNYRCTASH FLGTATHDFH VIVEEPPRWT KKPQSAVYST 360

GSNGILLCEA EGEPQPTIKW RVNGSPVDNH PFAGDVVFPR EISFTNLQPN HTAVYQCEAS 420

NVHGTILANA NIDVVDVRPL IQTKDGENYA TVVGYSAFLH CEFFASPEAV VSWQKVEEVK 480

PLEGRRYHIY ENGTLQINRT TEEDAGSYSC WVENAIGKTA VTANLDIRNA TKLRVSPKMP 540

RIPKLHMLEL HCESKCDSHL KHSLKLSWSK DGEAFEINGT EDGRIIIDGA NLTISNVTLE 600

DQGIYCCSAH TALDSAADIT QVTVLDVPDP PENLHLSERQ NRSVRLTWEA GADHNSNISE 660

YIVEFEGNKE EPGRWEELTR VQGKKTTVIL PLAPFVRYQF RVIAVNEVGR SQPSQPSDHH 720

ETPPAAPDRN PQNIRVQASQ PKEMIIKWEP LKSMEQNGPG LEYRVTWKPQ GAPVEWEEET 780
```

TABLE LIVb-continued

| Peptide sequences of protein coded by 282P1G03 v.3 |
|---|
| VTNHTLRVMT PAVYAPYDVK VQAINQLGSG PDPQSVTLYS GEDYPDTAPV IHGVDVINTT 840 |
| YVSNATGSPQ PSIFICSKEQ ELSYRNRNML AEDFIQKSTS CNYVEKSSTF FKI 893 |

TABLE LVb

Amino acid sequence alignment of 282P1G03 v.1 (SEQ ID NO: 161) and 282P1G03 v.3 (SEQ ID NO:162)

```
v.1    1 MEPLLLGRGLIVYLMFLLLKFSKAIEIPSSVQQVPTIIKQSKVQVAFPFD  50
         ||||||||||||||||||||||||||||||||||||||||||||||||||
v.3    1 MEPLLLGRGLIVYLMFLLLKFSKAIEIPSSVQQVPTIIKQSKVQVAFPFD  50

v.1   51 EYFQIECEAKGNPEPTFSWTKDGNPFYFTDHRIIPSNNSGTFRIPNEGHI 100
         ||||||||||||||||||||||||||||||||||||||||||||||||||
v.3   51 EYFQIECEAKGNPEPTFSWTKDGNPFYFTDHRIIPSNNSGTFRIPNEGHI 100

v.1  101 SHFQGKYRCFASNKLGIANSEEIEFIVPSVPKLPKEKIDPLEVEEGDPIV 150
         ||||||||||||||||||||||||||||||||||||||||||||||||||
v.3  101 SHFQGKYRCFASNKLGIAMSEEIEFIVPSVPKLPKEKIDPLEVEEGDPIV 150

v.1  151 LPCNPPKGLPPLHIYWMNIELEHIEQDERVYMSQKGDLYFANVEEKDSRH 200
         ||||||||||||||||||||||||||||||||||||||||||||||||||
v.3  151 LPCNPPKGLPPLHIYWMNIELEHIEQDERVYMSQKGDLYFANVEEKDSRN 200

v.1  201 DYCCFAAFPRLRTIVQKMPMKLTVNSLKHANDSSSSTEIGSKANSIKQRK 250
         ||||||||||||||||||||||||||||||||||||||||||||||||||
v.3  201 DYCCFAAFPRLRTIVQKNPMKLTVNSLKHANDSSSSTEIGSKANSIKQRK 250

v.1  251 PKLLLPPTESGSESSITILKGEILLLECFAEGLPTPQVDWNKIGGDLPKG 300
         ||||||||||||||||||||||||||||||||||||||||||||||||||
v.3  251 PKLLLPPTESGSESSITILKGEILLLECFAEGLPTPQVDWNKIGGDLPKG 300

v.1  301 RETKENYGKTLKIENVSYQDKGNYRCTASNFLGTATHDFHVIVEEPPRWT 350
         ||||||||||||||||||||||||||||||||||||||||||||||||||
v.3  301 RETKENYGKTLKIENVSYQDKGNYRCTASNFLGTATHDFHVIVEEPPRWT 350

v.1  351 KKPQSAVYSTGSNGILLCEAEGEPQPTIKWRVNGSPVDNHPFAGDVVFPR 400
         ||||||||||||||||||||||||||||||||||||||||||||||||||
v.3  351 KKPQSAVYSTGSNGILLCEAEGEPQPTIKWRVNGSPVDNHPFAGDVVFPR 400

v.1  401 EISFTHLQPNHTAVYQCEASNVHGTILANANIDVVDVRPLIQTKDGENYA 450
         ||||||||||||||||||||||||||||||||||||||||||||||||||
v.3  401 EISFTHLQPNHTAVYQCEASNVHGTILANANIDVVDVRPLIQTKDGENYA 450

v.1  451 TVVGYSAFLHCEFFASPEAVVSWQKVEEVKPLEGRRYHIYENGTLQIHRT 500
         ||||||||||||||||||||||||||||||||||||||||||||||||||
v.3  451 TVVGYSAFLHCEFFASPEAVVSWQKVEEVKPLEGRRYHIYENGTLQINRT 500

v.1  501 TEEDAGSYSCWVENAIGKTAVTANLDIRNATKLRVSPKNPRIPKLHMLEL 550
         ||||||||||||||||||||||||||||||||||||||||||||||||||
v.3  501 TEEDAGSYSCWVENAIGKTAVTANLDIRNATKLRVSPKNPRIPKLHMLEL 550

v.1  551 HCESKCDSHLKHSLKLSWSKDGEAFEINGTEDGRIIIDGANLTISNVTLE 600
         ||||||||||||||||||||||||||||||||||||||||||||||||||
v.3  551 HCESKCDSHLKHSLKLSWSKDGEAFEINGTEDGRIIIDGANLTISNVTLE 600

v.1  601 DQGIYCCSAHTALDSAADITQVTVLDVPDPPENLHLSERQNRSVRLTWEA 650
         ||||||||||||||||||||||||||||||||||||||||||||||||||
v.3  601 DQGIYCCSAHTALDSAADITQVTVLDVPDPPENLHLSERQNRSVRLTWEA 650

v.1  651 GADHNSNISEYIVEFEGNKEEPGRWEELTRVQGKKTTVILPLAPFVRYQF 700
         ||||||||||||||||||||||||||||||||||||||||||||||||||
v.3  651 GADHNSNISEYIVEFEGNKEEPGRWEELTRVQGKKTTVILPLAPFVRYQF 700

v.1  701 RVIAVNEVGRSQPSQPSDHHETPPAAPDRNPQNIRVQASQPKEMIIKWEP 750
         ||||||||||||||||||||||||||||||||||||||||||||||||||
v.3  701 RVIAVNEVGRSQPSQPSDHHETPPAAPDRNPQNIRVQASQPKEMIIKWEP 750

v.1  751 LKSMEQNGPGLEYRVTWKPQGAPVEWEEETVTNHTLRVMTPAVYAPYDVK 800
         ||||||||||||||||||||||||||||||||||||||||||||||||||
v.3  751 LKSMEQNGPGLEYRVTWKPQGAPVEWEEETVTNHTLRVMTPAVYAPYDVK 800
```

TABLE LVb-continued

Amino acid sequence alignment of 282P1G03 v.1 (SEQ ID NO: 161) and 282P1G03 v.3 (SEQ ID NO:162)

```
v.1  801 VQAINQLGSGPDPQSVTLYSGEDYPDTAPVIHGVDVIMSTLV-KVTWSTV  849
         ||||||||||||||||||||||||||||||||||||:|  |  | |
v.3  801 VQAINQLGSGPDPQSVTLYSGEDYPDTAPVIHGVDVIHTTYVSNATGSPQ  850

v.1  850 P 850
         |
v.3  851 P 851
```

TABLE LIIc

Nucleotide sequence of transcript variant 282P1G03 v.4

(SEQ ID NO:163)

```
cggaccctgc gcgcccccgt cccggctccc ggccggctcg ggggagaagg cgcccgaggg  60
gaggcgccgg acagatcgcg tttcggaggc ggcgcaggtg ctgtaaactg caaaccataa  120
tcctgtctta atactgcaaa caaatcatag tggaactaag ggaacttaa tttactgttt  180
ccaggttaac taaggtctca gctgtaaacc aaaagtgaga ggagacatta agattttcat  240
tcttaccggg ttgtcttctt cctgaagagc aatggagccg cttttacttg gaagaggact  300
aatcgtatat ctaatgttcc tcctgttaaa attctcaaaa gcaattgaaa taccatcttc  360
agttcaacag gttccaacaa tcataaaaca gtcaaaagtc caagttgcct ttcccttcga  420
tgagtatttt caaattgaat gtgaagctaa aggaaatcca gaaccaacat tttcgtggac  480
taaggatggc aacccttttt atttcactga ccatcggata attccatcga acaattcagg  540
aacattcagg atcccaaacg aggggcacat atctcacttt caagggaaat accgctgctt  600
tgcttcaaat aaactgggaa tcgctatgtc agaagaaata gaatttatag ttccaagtgt  660
tccaaaactc ccaaaagaaa aaattgaccc tcttgaagtg gaggagggag atccaattgt  720
cctcccatgc aatcctccca aaggcctccc acctttacac atttattgga tgaatattga  780
attagaacac atcgaacaag atgaaagagt atacatgagc caaaagggag atctatactt  840
cgcaaacgtg gaagaaaagg acagtcgcaa tgactactgt tgctttgctg catttccaag  900
attaaggact attgtacaga aaatgccaat gaaactaaca gttaacagtt taaagcatgc  960
taatgactca agttcatcca cagaaattgg ttccaaggca aattccatca agcaaagaaa  1020
acccaaactg ctgttgcctc ccactgagag tggcagtgag tcttcaatta ccatcctcaa  1080
aggggaaatc ttgctgcttg agtgtttttgc tgaaggcttg ccaactccac aggttgattg  1140
gaacaaaatt ggtggtgact taccaaaggg gagagaaaca aaagaaaatt atggcaagac  1200
tttgaagata gagaatgtct cctaccagga caaaggaaat tatcgctgca cagccagcaa  1260
tttcttggga acagccactc acgattttca cgttatagta gaagagcctc ctcgctggac  1320
aaagaagcct cagagtgctg tgtatagcac cggaagcaat ggcatcttgt tatgtgaggc  1380
tgaaggagaa cctcaaccca caatcaagtg gagagtcaat ggctccccag ttgacaatca  1440
tccatttgct ggtgatgttg tcttccccag ggaaatcagt tttaccaacc ttcaaccaaa  1500
tcatactgct gtgtaccagt gtgaagcctc aaatgtccat ggaactatcc ttgccaatgc  1560
caatattgat gttgtggatg tccgtccatt gatacaaacc aaagatggag aaaattacgc  1620
tacagtggtt gggtacagtg ctttcttaca ttgcgagttc tttgcttcac ctgaggcagt  1680
cgtgtcctgg cagaaggtgg aagaagtgaa acccctggag ggcaggcggt atcatatcta  1740
tgaaaatggc acattgcaga tcaacagaac caccgaagaa gatgctgggt cttactcatg  1800
```

TABLE LIIc-continued

| Nucleotide sequence of transcript variant 282P1G03 v.4 |
|---|
| ttgggtagaa aatgctatag gaaaaactgc agtcacagcc aatttggata ttagaaatgc 1860 |
| tacaaaactt agagtttctc ctaagaatcc tcgtatcccc aaattgcata tgcttgaatt 1920 |
| acattgtgaa agcaaatgtg actcacattt gaaacacagt ttgaagttgt cctggagtaa 1980 |
| agatggagaa gcctttgaaa ttaatggcac agaagatggc aggataatta ttgatggagc 2040 |
| taatttgacc atatctaatg taactttaga ggaccaaggt atttactgct gttcagctca 2100 |
| tactgctcta gacagtgctg ccgatataac tcaagtaact gttcttgatg ttccggatcc 2160 |
| accagaaaac cttcacttgt ctgaaagaca gaacaggagt gttcggctga cctgggaagc 2220 |
| tggagctgac cacaacagca atattagcga gtatattgtt gaatttgaag gaaacaaaga 2280 |
| agagcctgga aggtgggagg aactgaccag agtccaagga aagaaaacca cagttatctt 2340 |
| acctttggct ccatttgtga gataccagtt cagggtcata gccgtgaacg aagtagggag 2400 |
| aagtcagcct agccagccgt cagaccatca tgaaacacca ccagcagctc cagataggaa 2460 |
| tccacaaaac ataagggttc aagcctctca acccaaggaa atgattataa agtgggagcc 2520 |
| tttgaaatcc atggagcaga atggaccagg cctagagtac agagtgacct ggaagccaca 2580 |
| gggagcccca gtggagtggg aagaagaaac agtcacaaac cacacattgc gggtgatgac 2640 |
| gcctgctgtc tatgcccctt atgatgtcaa ggtccaggct atcaatcaac taggatctgg 2700 |
| gcctgaccct cagtcagtga ctctctattc tggagaagac ttacctgaac agccaacttt 2760 |
| tctaaaggtc atcaaagttg ataaagacac tgccacttta tcttggggac tacctaagaa 2820 |
| attaaatgga aacttaactg gctatctttt gcaatatcag ataataaatg acacctacga 2880 |
| gattggagaa ttaaatgata ttaacattac aactccatca aagcccagct ggcacctctc 2940 |
| aaacctgaat gcaactacca agtacaaatt ctacttgagg gcttgcactt cacagggctg 3000 |
| tggaaaaccg atcacggagg aaagctccac cttaggagaa gggagtaaag gtatcgggaa 3060 |
| gatatcagga gtaaatctta ctcaaaagac tcacccaata gaggtatttg agccgggagc 3120 |
| tgaacatata gttcgcctaa tgactaagaa ttggggcgat aacgatagca tttttcaaga 3180 |
| tgtaattgag acaagaggga gagaatatgc tggtttatat gatgacatct ccactcaagg 3240 |
| ctggtttatt ggactgatgt gtgcgattgc tcttctcaca ctactattat taactgtttg 3300 |
| ctttgtgaag aggaatagag gtggaaagta ctcagttaaa gaaaaggaag atttgcatcc 3360 |
| agacccagaa attcagtcag taaaagatga aacctttggt gaatacagtg acagtgatga 3420 |
| aaagcctctc aaaggaagcc ttcggtccct taatagggat atgcagccta ctgaaagtgc 3480 |
| tgacagctta gtcgaatacg gagagggaga ccatggtctc ttcagtgaag atggatcatt 3540 |
| tattggtgcc tacgctggat ctaaggagaa gggatctgtt gaaagcaatg gaagttctac 3600 |
| agcaactttt ccccttcggg cataaacaca acatatgtaa gcaacgctac tggttcaccc 3660 |
| caaccttcca tatttatctg ttcaaaggag caagaacttt catataggaa tagaaacatg 3720 |
| ctggccgaag atttcatcca gaagtcaaca tcctgcaatt atgttgaaaa gagtagtact 3780 |
| ttcttcaaaa tataaaatgc caagcacttc aggcctatgt tttgcttata ttgttttcag 3840 |
| gtgctcaaaa tgcaaaacac aaaacaaatc ctgcatttag atacacctca actaaatcca 3900 |
| aagtccccat tcagtatatt ccatatttgc ctgattttac tattcggtgt gtttgcatag 3960 |
| atgttgctac ttggtgggtt tttctccgta tgcacattgg tatacagtct ctgagaactg 4020 |
| gcttggtgac tttgcttcac tacaggttaa aagaccataa gcaaactggt tatttaaaat 4080 |
| gtaaaaagga atatgaaagt cttattaaaa cacttcattg aaaatataca gtctaaattt 4140 |

TABLE LIIc-continued

| Nucleotide sequence of transcript variant 282P1G03 v.4 |
|---|
| attatttaaa ttttactagc aaaagtctta ggtgaacaat caactagtat ttgttgagct 4200 |
| cctatttgcc cagagatggt catatttaaa cagaagtata cgtttttcag tttcaacatg 4260 |
| aatttttta tttctgtcag ttatgacatc cacgagcatc actttttgtg tctgtttttt 4320 |
| tttttttctt ggactaaatt caactgcatg gaagcggtgg tcagaaggtt gttttatacg 4380 |
| agaacaggca gaaagtgccc attgttcagg attctaatag ctacatctac ttaatatctt 4440 |
| catttctaaa ttgactgctt ttaccttttt ctcatgttta tataatggta tgcttgcata 4500 |
| tatttcatga atacattgta catattatgt taatatttac acaatttaaa atatagatgt 4560 |
| gttttatttt gaagtgagaa aatgaacatt aacaggcatg tttgtacagc tagaatatat 4620 |
| tagtaagata ctgtttttcg tcattccaga gctacaacta ataacacgag gttccaaagc 4680 |
| tgaagacttt gtataaagta tttgggtttt gttcttgtat tgctttcttt caacagtttc 4740 |
| aaaataaaat atcatacaaa tattgaggga aatgttttca tatttttcaa aataggtttt 4800 |
| tattgttgaa tgtacatcta ccccagcccc tcaaaagaaa aactgtttac atagaaattc 4860 |
| ctacacatac gtttgcgtat atgttatttt aaacatcttt gtggtgagaa ttttttcccc 4920 |
| gatattctcc ttctgtcaaa gtcagaacaa attcagggaa tttattttct ggcagttgtg 4980 |
| ctccagtcct tttaaaattg tacatgaaca tgttttagaa acaatatgga ggatgatgca 5040 |
| tacatgtcgg tcaagttcag cgctcgacat tttatggaaa gatttttta accttaccac 5100 |
| gaaatactta actactgttt aagtgaattg acttatttca ctttagtttt tgaactgtga 5160 |
| ttattggtat actgttatat cctcaacttg gatttatggt aacccctttt agttcatgga 5220 |
| gaccaaaatt tggggtattt ataatagtca gcgcaggaat gcacatggaa tatctacttg 5280 |
| tccttttgaa cctcacgagt catccagaat gtatagacag gaaaagcatg tcttatttaa 5340 |
| aactgtaatt tatgggctca ggatctgacc gcagtcccgg gagtaagcat ttcaaagggg 5400 |
| gaaggcagtg tggtccctac cctgtgtgaa tgtgaggatg tagacatcca tcagtgcaac 5460 |
| tcgagctcca tcctcctccg atttctaagg ctccagtttt ctggagggac agtcatcatg 5520 |
| ttttgattta tctgggagaa aactgtggtg cacagcttgt gaggagggca aggttgtgac 5580 |
| gttcgagctt agttctggtg ttattctgtc tcctcttctt tgtcatcagc caaaacgtgg 5640 |
| tttttaaaga gagtcatgca ggttagaaat aatgtcaaaa atatttagga atttaataac 5700 |
| ctttaagtca gaaactaaaa caaatactga aatattagct cttcctacac ttcgtgttcc 5760 |
| cctttagctg cctgaaaatc aagattgctc ctactcagat cttctgagtg gctaaaactt 5820 |
| atggatatga aaaatgagat tgaatgatga ctatgctttg ctatcattgt tacctttcct 5880 |
| caatactatt tggcaactac tgggactctt cagcacaaaa ggaatagatc tatgattgac 5940 |
| cctgatttta attgtgaaat tatatgattc atatatttta tgaatcagaa taaccttcaa 6000 |
| ataaaataaa tctaagtcgg ttaaaatgga tttcatgatt ttccctcaga aaatgagtaa 6060 |
| cggagtccac ggcgtgcaat ggtaattata aattggtgat gcttgtttgc aaattgccca 6120 |
| ctcytgataa gtcaacagcc aatatttaaa actttgttcg ttactggctt taccctaact 6180 |
| ttctctagtc tactgtcaat atcattttaa tgtaattgat tgtatatagt ctcaagaatg 6240 |
| gttggtgggc atgagttcct agagaactgt ccaagggttg ggaaaatcca aattctcttc 6300 |
| ctggctccag cactgatttt gtacataaac attaggcagg ttgcttaacc tttttatttc 6360 |
| aaactctctc aactctaaag tgctaataat aatctcagtt accttatctt tgtcacaggg 6420 |

TABLE LIIc-continued

| Nucleotide sequence of transcript variant 282P1G03 v.4 | |
|---|---|
| tgttcttttt tatgaagaaa aatttgaaaa tgataaaagc taagatgcct tctaacttca | 6480 |
| taagcaaacc tttaactaat tatgtatctg aaagtcaccc ccacatacca actcaacttt | 6540 |
| tttcctgtga acacataaat atatttttat agaaaaacaa atctacataa aataaatcta | 6600 |
| ctgtttagtg agcagtatga cttgtacatg ccattgaaaa ttattaatca gaagaaaatt | 6660 |
| aagcagggtc tttgctatac aaaagtgttt tccactaatt ttgcatgcgt atttataaga | 6720 |
| aaaatgtgaa tttggtggtt ttattctatc ggtataaagg catcgatatt ttagatgcac | 6780 |
| ccgtgtttgt aaaaatgtag agcacaatgg aattatgctg gaagtctcaa ataatatttt | 6840 |
| tttcctattt tatactcatg gaagagataa gctaaagagg ggacaataat gagaaatgtt | 6900 |
| ggtgtgcttt tctaagcatt taaaacataa ttgccaattg aaaccctaaa tatgtttaca | 6960 |
| taccattaag atatgattca tgtaacaatg ttaaattaat tataatggga ttgggtttgt | 7020 |
| tatctgtggt agtatatatc ctagtgttcc tatagtgaaa taagtagggt tcagccaaag | 7080 |
| ctttctttgt tttgtacctt aaattgttcg attacgtcat caaaagagat gaaaggtatg | 7140 |
| tagaacaggt tcacgtgatt acctttttct tttggcttgg attaatattc atagtagaac | 7200 |
| tttataaaac gtgtttgtat tgtaggtggt gtttgtatta tgcttatgac tatgtatggt | 7260 |
| ttgaaaatat tttcattata catgaaattc aactttccaa ataaaagttc tacttcatgt | 7320 |
| aatccaaaa 7329 | |

TABLE LIIIc

Nucleotide sequence alignment of 282P1G03 v.1 (SEQ ID NO: 164) and 282P1G03 v.4 (SEQ ID NO: 165)

```
v.1    1  cggaccctgcgcgcccccgtcccggctcccggccggctcgggggagaagg  50
          ||||||||||||||||||||||||||||||||||||||||||||||||||
v.4    1  CGGACCCTGCGCGCCCCCGTCCCGGCTCCCGGCCGGCTCGGGGGAGAAGG  50

v.1   51  cgcccgagggg aggcgccggacagatcgcgtttcggaggcggcgcaggtg 100
          ||||||||||||||||||||||||||||||||||||||||||||||||||
v.4   51  CGCCCGAGGGGAGGCGCCGGACAGATCGCGTTTCGGAGGCGGCGCAGGTG 100

v.1  101  ctgtaaactgcaaaccataatcctgtcttaatactgcaaacaaatcatag 150
          ||||||||||||||||||||||||||||||||||||||||||||||||||
v.4  101  CTGTAAACTGCAAACCATAATCCTGTCTTAATACTGCAAACAAATCATAG 150

v.1  151  tggaactaaggggaacttaatttactgtttccaggttaactaaggtctca 200
          ||||||||||||||||||||||||||||||||||||||||||||||||||
v.4  151  TGGAACTAAGGGGAACTTAATTTACTGTTTCCAGGTTAACTAAGGTCTCA 200

v.1  201  gctgtaaaccaaaagtgagaggagacattaagattttcattcttaccggg 250
          ||||||||||||||||||||||||||||||||||||||||||||||||||
v.4  201  GCTGTAAACCAAAAGTGAGAGGAGACATTAAGATTTTCATTCTTACCGGG 250

v.1  251  ttgtcttcttcctgaagagcaatggagccgcttttacttggaagaggact 300
          ||||||||||||||||||||||||||||||||||||||||||||||||||
v.4  251  TTGTCTTCTTCCTGAAGAGCAATGGAGCCGCTTTTACTTGGAAGAGGACT 300

v.1  301  aatcgtatatctaatgttcctcctgttaaaattctcaaaagcaattgaaa 350
          ||||||||||||||||||||||||||||||||||||||||||||||||||
v.4  301  AATCGTATATCTAATGTTCCTCCTGTTAAAATTCTCAAAAGCAATTGAAA 350

v.1  351  taccatcttcagttcaacaggttccaacaatcataaaacagtcaaaagtc 400
          ||||||||||||||||||||||||||||||||||||||||||||||||||
v.4  351  TACCATCTTCAGTTCAACAGGTTCCAACAATCATAAAACAGTCAAAAGTC 400

v.1  401  caagttgcctttcccttcgatgagtattttcaaattgaatgtgaagctaa 450
          ||||||||||||||||||||||||||||||||||||||||||||||||||
v.4  401  CAAGTTGCCTTTCCCTTCGATGAGTATTTTCAAATTGAATGTGAAGCTAA 450

v.1  451  aggaaatccagaaccaacattttcgtggactaaggatggcaacccttttt 500
```

TABLE LIIIc-continued

Nucleotide sequence alignment of 282P1G03 v.1 (SEQ ID NO: 164) and 282P1G03 v.4 (SEQ ID NO: 165)

```
               ||||||||||||||||||||||||||||||||||||||||||||||||||
v.4    451  AGGAAATCCAGAACCAACATTTTCGTGGACTAAGGATGGCAACCCTTTTT  500

v.1    501  atttcactgaccatcggataattccatcgaacaattcaggaacattcagg  550
               ||||||||||||||||||||||||||||||||||||||||||||||||||
v.4    501  ATTTCACTGACCATCGGATAATTCCATCGAACAATTCAGGAACATTCAGG  550

v.1    551  atcccaaacgaggggcacatatctcactttcaagggaaataccgctgctt  600
               ||||||||||||||||||||||||||||||||||||||||||||||||||
v.4    551  ATCCCAAACGAGGGGCACATATCTCACTTTCAAGGGAAATACCGCTGCTT  600

v.1    601  tgcttcaaataaactgggaatcgctatgtcagaagaaatagaatttatag  650
               ||||||||||||||||||||||||||||||||||||||||||||||||||
v.4    601  TGCTTCAAATAAACTGGGAATCGCTATGTCAGAAGAAATAGAATTTATAG  650

v.1    651  ttccaagtgttccaaaactcccaaaagaaaaaattgaccctcttgaagtg  700
               ||||||||||||||||||||||||||||||||||||||||||||||||||
v.4    651  TTCCAAGTGTTCCAAAACTCCCAAAAGAAAAAATTGACCCTCTTGAAGTG  700

v.1    701  gaggagggagatccaattgtcctcccatgcaatcctcccaaaggcctccc  750
               ||||||||||||||||||||||||||||||||||||||||||||||||||
v.4    701  GAGGAGGGAGATCCAATTGTCCTCCCATGCAATCCTCCCAAAGGCCTCCC  750

v.1    751  acctttacacatttattggatgaatattgaattagaacacatcgaacaag  800
               ||||||||||||||||||||||||||||||||||||||||||||||||||
v.4    751  ACCTTTACACATTTATTGGATGAATATTGAATTAGAACACATCGAACAAG  800

v.1    801  atgaaagagtatacatgagccaaaagggagatctatacttcgcaaacgtg  850
               ||||||||||||||||||||||||||||||||||||||||||||||||||
v.4    801  ATGAAAGAGTATACATGAGCCAAAAGGGAGATCTATACTTCGCAAACGTG  850

v.1    851  gaagaaaaggacagtcgcaatgactactgttgctttgctgcatttccaag  900
               ||||||||||||||||||||||||||||||||||||||||||||||||||
v.4    851  GAAGAAAAGGACAGTCGCAATGACTACTGTTGCTTTGCTGCATTTCCAAG  900

v.1    901  attaaggactattgtacagaaaatgccaatgaaactaacagttaacagtt  950
               ||||||||||||||||||||||||||||||||||||||||||||||||||
v.4    901  ATTAAGGACTATTGTACAGAAAATGCCAATGAAACTAACAGTTAACAGTT  950

v.1    951  taaagcatgctaatgactcaagttcatccacagaaattggttccaaggca  1000
               ||||||||||||||||||||||||||||||||||||||||||||||||||
v.4    951  TAAAGCATGCTAATGACTCAAGTTCATCCACAGAAATTGGTTCCAAGGCA  1000

v.1   1001  aattccatcaagcaaagaaaacccaaactgctgttgcctcccactgagag  1050
               ||||||||||||||||||||||||||||||||||||||||||||||||||
v.4   1001  AATTCCATCAAGCAAAGAAAACCCAAACTGCTGTTGCCTCCCACTGAGAG  1050

v.1   1051  tggcagtgagtcttcaattaccatcctcaaaggggaaatcttgctgcttg  1100
               ||||||||||||||||||||||||||||||||||||||||||||||||||
v.4   1051  TGGCAGTGAGTCTTCAATTACCATCCTCAAAGGGGAAATCTTGCTGCTTG  1100

v.1   1101  agtgttttgctgaaggcttgccaactccacaggttgattggaacaaaatt  1150
               ||||||||||||||||||||||||||||||||||||||||||||||||||
v.4   1101  AGTGTTTTGCTGAAGGCTTGCCAACTCCACAGCTTGATTGGAACAAAATT  1150

v.1   1151  ggtggtgacttaccaaaggggagagaaacaaaagaaaattatggcaagac  1200
               ||||||||||||||||||||||||||||||||||||||||||||||||||
v.4   1151  GGTGGTGACTTACCAAAGGGGAGAGAAACAAAAGAAAATTATGGCAAGAC  1200

v.1   1201  tttgaagatagagaatgtctcctaccaggacaaaggaaattatcgctgca  1250
               ||||||||||||||||||||||||||||||||||||||||||||||||||
v.4   1201  TTTGAAGATAGAGAATGTCTCCTACCAGGACAAAGGAAATTATCGCTGCA  1250

v.1   1251  cagccagcaatttcttgggaacagccactcacgattttcacgttatagta  1300
               ||||||||||||||||||||||||||||||||||||||||||||||||||
v.4   1251  CAGCCAGCAATTTCTTGGGAACAGCCACTCACGATTTTCACGTTATAGTA  1300

v.1   1301  gaagagcctcctcgctggacaaagaagcctcagagtgctgtgtatagcac  1350
               ||||||||||||||||||||||||||||||||||||||||||||||||||
v.4   1301  GAAGAGCCTCCTCGCTGGACAAAGAAGCCTCAGAGTGCTGTGTATAGCAC  1350

v.1   1351  cggaagcaatggcatcttgttatgtgaggctgaaggagaacctcaaccca  1400
               ||||||||||||||||||||||||||||||||||||||||||||||||||
v.4   1351  CGGAAGCAATGGCATCTTGTTATGTGAGGCTGAAGGAGAACCTCAACCCA  1400

v.1   1401  caatcaagtggagagtcaatggctccccagttgacaatcatccatttgct  1450
```

TABLE LIIIc-continued

Nucleotide sequence alignment of 282P1G03 v.1 (SEQ ID NO: 164) and 282P1G03 v.4 (SEQ ID NO: 165)

```
               ||||||||||||||||||||||||||||||||||||||||||||||||||
v.4  1401  CAATCAAGTGGAGAGTCAATGGCTCCCCAGTTGACAATCATCCATTTGCT  1450

v.1  1451  ggtgatgttgtcttccccagggaaatcagttttaccaaccttcaaccaaa  1500
           ||||||||||||||||||||||||||||||||||||||||||||||||||
v.4  1451  GGTGATGTTGTCTTCCCCAGGGAAATCAGTTTTACCAACCTTCAACCAPA  1500

v.1  1501  tcatactgctgtgtaccagtgtgaagcctcaaatgtccatggaactatcc  1550
           ||||||||||||||||||||||||||||||||||||||||||||||||||
v.4  1501  TCATACTGCTGTGTACCAGTGTGAAGCCTCAAATGTCCATGGAACTATCC  1550

v.1  1551  ttgccaatgccaatattgatgttgtggatgtccgtccattgatacaaacc  1600
           ||||||||||||||||||||||||||||||||||||||||||||||||||
v.4  1551  TTGCCAATGCCAATATTGATGTTGTGGATGTCCGTCCATTGATACAAACC  1600

v.1  1601  aaagatggagaaaattacgctacagtggttgggtacagtgctttcttaca  1650
           ||||||||||||||||||||||||||||||||||||||||||||||||||
v.4  1601  AAAGATGGAGAAAATTACGCTACAGTCGTTGGGTACAGTGCTTTCTTACA  1650

v.1  1651  ttgcgagttctttgcttcacctgaggcagtcgtgtcctggcagaaggtgg  1700
           ||||||||||||||||||||||||||||||||||||||||||||||||||
v.4  1651  TTGCGAGTTCTTTGCTTCACCTGAGGCAGTCGTGTCCTGGCAGAAGGTGG  1700

v.1  1701  aagaagtgaaacccctggagggcaggcggtatcatatctatgaaaatggc  1750
           ||||||||||||||||||||||||||||||||||||||||||||||||||
v.4  1701  AAGAAGTGAAACCCCTGGAGGGCAGGCGGTATCATATCTATGAAAATGGC  1750

v.1  1751  acattgcagatcaacagaaccaccgaagaagatgctgggtcttactcatg  1800
           ||||||||||||||||||||||||||||||||||||||||||||||||||
v.4  1751  ACATTGCAGATCAACAGAACCACCGAAGAAGATGCTGGGTCTTACTCATG  1800

v.1  1801  ttgggtagaaaatgctataggaaaaactgcagtcacagccaatttggata  1850
           ||||||||||||||||||||||||||||||||||||||||||||||||||
v.4  1801  TTGGGTAGAAAATGCTATAGGAAAAACTGCAGTCACAGCCAATTTGGATA  1850

v.1  1851  ttagaaatgctacaaaacttagagtttctcctaagaatcctcgtatcccc  1900
           ||||||||||||||||||||||||||||||||||||||||||||||||||
v.4  1851  TTAGAAATGCTACAAAACTTAGAGTTTCTCCTAAGAATCCTCGTATCCCC  1900

v.1  1901  aaattgcatatgcttgaattacattgtgaaagcaaatgtgactcacattt  1950
           ||||||||||||||||||||||||||||||||||||||||||||||||||
v.4  1901  AAATTGCATATGCTTGAATTACATTGTGAAAGCAAATGTGACTCACATTT  1950

v.1  1951  gaaacacagtttgaagttgtcctggagtaaagatggagaagcctttgaaa  2000
           ||||||||||||||||||||||||||||||||||||||||||||||||||
v.4  1951  GAAACACAGTTTGAAGTTGTCCTGGAGTAAAGATGGAGAAGCCTTTGAAA  2000

v.1  2001  ttaatggcacagaagatggcaggataattattgatggagctaatttgacc  2050
           ||||||||||||||||||||||||||||||||||||||||||||||||||
v.4  2001  TTAATGGCACAGAAGATGGCAGGATAATTATTGATGGAGCTAATTTGACC  2050

v.1  2051  atatctaatgtaactttagaggaccaaggtatttactgctgttcagctca  2100
           ||||||||||||||||||||||||||||||||||||||||||||||||||
v.4  2051  ATATCTAATGTAACTTTAGAGGACCAAGGTATTTACTGCTGTTCAGCTCA  2100

v.1  2101  tactgctctagacagtgctgccgatataactcaagtaactgttcttgatg  2150
           ||||||||||||||||||||||||||||||||||||||||||||||||||
v.4  2101  TACTGCTCTAGACAGTGCTGCCGATATAACTCAAGTAACTGTTCTTGATG  2150

v.1  2151  ttccggatccaccagaaaaccttcacttgtctgaaagacagaacaggagt  2200
           ||||||||||||||||||||||||||||||||||||||||||||||||||
v.4  2151  TTCCGGATCCACCAGAAAACCTTCACTTGTCTGAAAGACAGAACAGGAGT  2200

v.1  2201  gttcggctgacctgggaagctggagctgaccacaacagcaatattagcga  2250
           ||||||||||||||||||||||||||||||||||||||||||||||||||
v.4  2201  GTTCGGCTGACCTGGGAAGCTGGAGCTGACCACAACAGCAATATTAGCGA  2250

v.1  2251  gtatattgttgaatttgaaggaaacaaagaagagcctggaaggtgggagg  2300
           ||||||||||||||||||||||||||||||||||||||||||||||||||
v.4  2251  GTATATTGTTGAATTTGAAGGAAACAAAGAAGAGCCTGGAAGGTGGGAGG  2300

v.1  2301  aactgaccagagtccaaggaaagaaaaccacagttatcttacctttggct  2350
           ||||||||||||||||||||||||||||||||||||||||||||||||||
v.4  2301  AACTGACCAGAGTCCAAGGAAAGAAAACCACAGTTATCTTACCTTTGGCT  2350

v.1  2351  ccatttgtgagataccagttcagggtcatagccgtgaacgaagtagggag  2400
```

TABLE LIIIc-continued

Nucleotide seguence alignment of 282P1G03 v.1 (SEQ ID NO: 164) and 282P1G03 v.4 (SEQ ID NO: 165)

```
               ||||||||||||||||||||||||||||||||||||||||||||||||||
v.4  2351  CCATTTGTGAGATACCAGTTCAGGGTCATAGCCGTGAACGAAGTAGGGAG  2400

v.1  2401  aagtcagcctagccagccgtcagaccatcatgaaacaccaccagcagctc  2450
           ||||||||||||||||||||||||||||||||||||||||||||||||||
v.4  2401  AAGTCAGCCTAGCCAGCCGTCAGACCATCATGAAACACCACCAGCAGCTC  2450

v.1  2451  cagataggaatccacaaaacataagggttcaagcctctcaacccaaggaa  2500
           ||||||||||||||||||||||||||||||||||||||||||||||||||
v.4  2451  CAGATAGGAATCCACAAAACATAAGGGTTCAAGCCTCTCAACCCAAGGAA  2500

v.1  2501  atgattataaagtgggagcctttgaaatccatggagcagaatggaccagg  2550
           ||||||||||||||||||||||||||||||||||||||||||||||||||
v.4  2501  ATGATTATAPAGTGGGAGCCTTTGAAATCCATGGAGCAGAATGGACCAGG  2550

v.1  2551  cctagagtacagagtgacctggaagccacagggagccccagtggagtggg  2600
           ||||||||||||||||||||||||||||||||||||||||||||||||||
v.4  2551  CCTAGAGTACAGAGTGACCTGGAAGCCACAGGGAGCCCCAGTGGAGTGGG  2600

v.1  2601  aagaagaaacagtcacaaaccacacattgcgggtgatgacgcctgctgtc  2650
           ||||||||||||||||||||||||||||||||||||||||||||||||||
v.4  2601  AAGAAGAAACAGTCACAAACCACACATTGCGGGTGATGACGCCTGCTGTC  2650

v.1  2651  tatgccccttatgatgtcaaggtccaggctatcaatcaactaggatctgg  2700
           ||||||||||||||||||||||||||||||||||||||||||||||||||
v.4  2651  TATGCCCCTTATGATGTCAAGGTCCAGGCTATCAATCAACTAGGATCTGG  2700

v.1  2701  gcctgaccctcagtcagtgactctctattctggagaagactatcctgata  2750
           |||||||||||||||||||||||||||||||||||||||||
v.4  2701  GCCTGACCCTCAGTCAGTGACTCTCTATTCTGGAGAAGACT---------  2741

v.1  2751  cagctccagtgatccatggggtggacgttataaacagtacattagttaaa  2800

v.4  2742  --------------------------------------------------  2741

v.1  2801  gttacctggtcaacagttccaaaggacagagtacatggacgtctgaaagg  2850

v.4  2742  --------------------------------------------------  2741

v.1  2851  ctatcagataaattggtggaaaacaaaaagtctgttggatggaagaacac  2900

v.4  2742  --------------------------------------------------  2741

v.1  2901  atcccaaagaagtgaacattctaagattttcaggacaaagaaactctgga  2950

v.4  2742  --------------------------------------------------  2741

v.1  2951  atggttccttccttagatgcctttagtgaatttcatttaacagtcttagc  3000

v.4  2742  --------------------------------------------------  2741

v.1  3001  ctataactctaaaggagctggtcctgaaagtgagccttatatatttcaaa  3050

v.4  2742  --------------------------------------------------  2741

v.1  3051  caccagaaggagtacctgaacagccaacttttctaaaggtcatcaaagtt  3100
                       ||||||||||||||||||||||||||||||||||||||
v.4  2742  ------------TACCTGAACAGCCAACTTTTCTAAAGGTCATCAAAGTT  2779

v.1  3101  gataaagacactgccactttattttggggactacctaagaaattaaatgg  3150
           ||||||||||||||||||||||||||||||||||||||||||||||||||
v.4  2780  GATAAAGACACTGCCACTTTATCTTGGGGACTACCTAAGAAATTAAATGG  2829

v.1  3151  aaacttaactggctatcttttgcaatatcagataataaatgacacctacg  3200
           ||||||||||||||||||||||||||||||||||||||||||||||||||
v.4  2830  AAACTTAACTGGCTATCTTTTGCAATATCAGATAATAAATGACACCTACG  2879

v.1  3201  agattggagaattaaatgatattaacattacaactccatcaaagcccagc  3250
           ||||||||||||||||||||||||||||||||||||||||||||||||||
v.4  2880  AGATTGGAGAATTAAATGATATTAACATTACAACTCCATCAAAGCCCAGC  2929

v.1  3251  tggcacctctcaaacctgaatgcaactaccaagtacaaattctacttgag  3300
           ||||||||||||||||||||||||||||||||||||||||||||||||||
v.4  2930  TGGCACCTCTCAAACCTGAATQCAACTACCAAGTACAAATTCTACTTGAG  2979

v.1  3301  ggcttgcacttcacagggctgtggaaaaccgatcacggaggaaagctcca  3350
```

TABLE LIIIc-continued

Nucleotide seguence alignment of 282P1G03 v.1 (SEQ ID NO: 164) and 282P1G03 v.4 (SEQ ID NO: 165)

```
               ||||||||||||||||||||||||||||||||||||||||||||||||||
v.4  2980  GGCTTGCACTTCACAGGGCTGTGGAAAACCGATCACGGAGGAAAGCTCCA  3029

v.1  3351  ccttaggagaagggagtaaaggtatcgggaagatatcaggagtaaatctt  3400
           ||||||||||||||||||||||||||||||||||||||||||||||||||
v.4  3030  CCTTAGGAGAAGGGAGTAAAGGTATCGGGAAGATATCAGGAGTAAATCTT  3079

v.1  3401  actcaaaagactcacccaatagaggtatttgagccgggagctgaacatat  3450
           ||||||||||||||||||||||||||||||||||||||||||||||||||
v.4  3080  ACTCAAAAGACTCACCCAATAGAGGTATTTGAGCCGGGAGCTGAACATAT  3129

v.1  3451  agttcgcctaatgactaagaattggggcgataacgatagcatttttcaag  3500
           ||||||||||||||||||||||||||||||||||||||||||||||||||
v.4  3130  AGTTCGCCTAATGACTAAGAATTGGGGCGATAACGATAGCATTTTTCAAG  3179

v.1  3501  atgtaattgagacaagagggagagaatatgctggtttatatgatgacatc  3550
           ||||||||||||||||||||||||||||||||||||||||||||||||||
v.4  3180  ATGTAATTGAGACAAGAGGGAGAGAATATGCTGGTTTATATGATGACATC  3229

v.1  3551  tccactcaaggctggtttattggactgatgtgtgcgattgctcttctcac  3600
           ||||||||||||||||||||||||||||||||||||||||||||||||||
v.4  3230  TCCACTCAAGGCTGGTTTATTGGACTGATGTGTGCGATTGCTCTTCTCAC  3279

v.1  3601  actactattattaactgtttgctttgtgaagaggaatagaggtggaaagt  3650
           ||||||||||||||||||||||||||||||||||||||||||||||||||
v.4  3280  ACTACTATTATTAACTGTTTGCTTTGTGAAGAGGAATAGAGGTGGAAAGT  3329

v.1  3651  actcagttaaagaaaaggaagatttgcatccagacccagaaattcagtca  3700
           ||||||||||||||||||||||||||||||||||||||||||||||||||
v.4  3330  ACTCAGTTAAAGAAAAGGAAGATTTGCATCCAGACCCAGAAATTCAGTCA  3379

v.1  3701  gtaaaagatgaaacctttggtgaatacagtgacagtgatgaaaagcctct  3750
           ||||||||||||||||||||||||||||||||||||||||||||||||||
v.4  3380  GTAAAAGATGAAACCTTTGGTGAATACAGTGACAGTGATGAAAAGCCTCT  3429

v.1  3751  caaaggaagccttcggtcccttaatagggatatgcagcctactgaaagtg  3800
           ||||||||||||||||||||||||||||||||||||||||||||||||||
v.4  3430  CAAAGGAAGCCTTCGGTCCCTTAATAGGGATATGCAGCCTACTGAAAGTG  3479

v.1  3801  ctgacagcttagtcgaatacggagagggagaccatggtctcttcagtgaa  3850
           ||||||||||||||||||||||||||||||||||||||||||||||||||
v.4  3480  CTGACAGCTTAGTCGAATACGGAGAGGGAGACCATGGTCTCTTCAGTGAA  3529

v.1  3851  gatggatcatttattggtgcctacgctggatctaaggagaagggatctgt  3900
           ||||||||||||||||||||||||||||||||||||||||||||||||||
v.4  3530  GATGGATCATTTATTGGTGCCTACGCTGGATCTAAGGAGAAGGGATCTGT  3579

v.1  3901  tgaaagcaatggaagttctacagcaacttttccccttcgggcataaacac  3950
           ||||||||||||||||||||||||||||||||||||||||||||||||||
v.4  3580  TGAAAGCAATGGAAGTTCTACAGCAACTTTTCCCCTTCGGGCATAAACAC  3629

v.1  3951  aacatatgtaagcaacgctactggttcaccccaaccttccatatttatct  4000
           ||||||||||||||||||||||||||||||||||||||||||||||||||
v.4  3630  AACATATGTAAGCAACGCTACTGGTTCACCCCAACCTTCCATATTTATCT  3679

v.1  4001  gttcaaaggagcaagaactttcatataggaatagaaacatgctggccgaa  4050
           ||||||||||||||||||||||||||||||||||||||||||||||||||
v.4  3680  GTTCAAAGGAGCAAGAACTTTCATATAGGAATAGAAACATGCTGGCCGAA  3729

v.1  4051  gatttcatccagaagtcaacatcctgcaattatgttgaaaagagtagtac  4100
           ||||||||||||||||||||||||||||||||||||||||||||||||||
v.4  3730  GATTTCATCCAGAAGTCAACATCCTGCAATTATGTTGAAAAGAGTAGTAC  3779

v.1  4101  tttcttcaaaatataaaatgccaagcacttcaggcctatgttttgcttat  4150
           ||||||||||||||||||||||||||||||||||||||||||||||||||
v.4  3780  TTTCTTCAAAATATAAAATGCCAAGCACTTCAGGCCTATGTTTTGCTTAT  3829

v.1  4151  attgttttcaggtgctcaaaatgcaaaacacaaaacaaatcctgcattta  4200
           ||||||||||||||||||||||||||||||||||||||||||||||||||
v.4  3830  ATTGTTTTCAGGTGCTCAAAATGCAAAACACAAAACAAATCCTGCATTTA  3879

v.1  4201  gatacacctcaactaaatccaaagtccccattcagtatattccatatttg  4250
           ||||||||||||||||||||||||||||||||||||||||||||||||||
v.4  3880  GATACACCTCAACTAkATCCAAAGTCCCCATTCAGTATATTCCATATTTG  3929

v.1  4251  cctgattttactattcggtgtgtttgcatagatgttgctacttggtgggt  4300
```

TABLE LIIIc-continued

| Nucleotide sequence alignment of 282P1G03 v.1 (SEQ ID NO: 164) and 282P1G03 v.4 (SEQ ID NO: 165) | | | |
|---|---|---|---|
| v.4 | 3930 | CCTGATTTTACTATTCGGTGTGTTTGCATAGATGTTGCTACTTGGTGGGT | 3979 |
| v.1 | 4301 | ttttctccgtatgcacattggtatacagtctctgagaactggcttggtga | 4350 |
| v.4 | 3980 | TTTTCTCCGTATGCACATTGGTATACAGTCTCTGAGAACTGGCTTGGTGA | 4029 |
| v.1 | 4351 | ctttgcttcactacaggttaaaagaccataagcaaactggttatttaaaa | 4400 |
| v.4 | 4030 | CTTTGCTTCACTACAGGTTAAAAGACCATAAGCAAACTGGTTATTTAAAA | 4079 |
| v.1 | 4401 | tgtaaaaaggaatatgaaagtcttattaaaacacttcattgaaaatatac | 4450 |
| v.4 | 4080 | TGTAAAAAGGAATATGAAAGTCTTATTAAAACACTTCATTGAAAATATAC | 4129 |
| v.1 | 4451 | agtctaaatttattatttaaattttactagcaaaagtcttaggtgaacaa | 4500 |
| v.4 | 4130 | AGTCTAAATTTATTATTTAAATTTTACTAGCAAAAGTCTTAGGTGAACAA | 4179 |
| v.1 | 4501 | tcaactagtatttgttgagctcctatttgcccagagatggtcatatttaa | 4550 |
| v.4 | 4180 | TCAACTAGTATTTGTTGAGCTCCTATTTGCCCAGAGATGGTCATATTTAA | 4229 |
| v.1 | 4551 | acagaagtatacgtttttcagtttcaacatgaatttttttatttctgtca | 4600 |
| v.4 | 4230 | ACAGAAGTATACGTTTTTCAGTTTCAACATGAATTTTTTTATTTCTGTCA | 4279 |
| v.1 | 4601 | gttatgacatccacgagcatcacttttttgtgtctgtttttttttttttct | 4650 |
| v.4 | 4280 | GTTATGACATCCACgAGCATCACTTTTTGTGTCTGTTTTTTTTTTTTTCT | 4329 |
| v.1 | 4651 | tggactaaattcaactgcatggaagcggtggtcagaaggttgttttatac | 4700 |
| v.4 | 4330 | TGGACTAAATTCAACTGCATGGAAGCGGTGGTCAGAAGGTTGTTTTATAC | 4379 |
| v.1 | 4701 | gagaacaggcagaaagtgcccattgttcaggattctaatagctacatcta | 4750 |
| v.4 | 4380 | GAGAACAGGCAGAAAGTGCCCATTGTTCAGGATTCTAATAGCTACATCTA | 4429 |
| v.1 | 4751 | cttaatatcttcatttctaaattgactgcttttacctttttctcatgttt | 4800 |
| v.4 | 4430 | CTTAATATCTTCATTTCTAAATTGACTGCTTTTACCTTTTTCTCATGTTT | 4479 |
| v.1 | 4801 | atataatggtatgcttgcatatatttcatgaatacattgtacatattatg | 4850 |
| v.4 | 4480 | ATATAATGGTATGCTTGCATATATTTCATGAATACATTGTACATATTATG | 4529 |
| v.1 | 4851 | ttaatatttacacaatttaaaatatagatgtgttttattttgaagtgaga | 4900 |
| v.4 | 4530 | TTAATATTTACACAATTTAAAATATAGATGTGTTTTATTTTGAAGTGAGA | 4579 |
| v.1 | 4901 | aaatgaacattaacaggcatgtttgtacagctagaatatattagtaagat | 4950 |
| v.4 | 4580 | AAATGAACATTAACAGGCATGTTTGTACAGCTAGAATATATTAGTAAGAT | 4629 |
| v.1 | 4951 | actgtttttcgtcattccagagctacaactaataacacgaggttccaaag | 5000 |
| v.4 | 4630 | ACTGTTTTTCGTCATTCCAGAGCTACAACTAATAACACGAGGTTCCAAAG | 4679 |
| v.1 | 5001 | ctgaagactttgtataaagtatttgggttttgttcttgtattgctttctt | 5050 |
| v.4 | 4680 | CTGAAGACTTTGTATA[ ]AGTATTTGGGTTTTGTTCTTGTAT-TGCTTTCTT | 4729 |
| v.1 | 5051 | tcaacagtttcaaaataaaatatcatacaaatattgagggaaatgttttc | 5100 |
| v.4 | 4730 | TCAACAGTTTCAAAATAAAATATCATAcAAATATTGAGGGAAATGTTTTC | 4779 |
| v.1 | 5101 | atatttttcaaaataggtttttattgttgaatgtacatctaccccagccc | 5150 |
| v.4 | 4780 | ATATTTTTCAAAATAGGTTTTTATTGTTGAATGTACATCTACCCCAGCCC | 4829 |
| v.1 | 5151 | ctcaaaagaaaaactgtttacatagaaattcctacacatacgtttgcgta | 5200 |
| v.4 | 4830 | CTCAAIAAGAAAAACTGTTTACATAGAAATTCCTACACATACGTTTGCGTA | 4879 |

TABLE LIIIc-continued

Nucleotide seguence alignment of 282P1G03 v.1 (SEQ ID NO: 164) and 282P1G03 v.4 (SEQ ID NO: 165)

```
v.1  5201  tatgttattttaaacatctttgtggtgagaatttttttccccgatattctc  5250
           ||||||||||||||||||||||||||||||||||||||||||||||||||
v.4  4880  TATGTTATTTTAAACATCTTTGTGGTGAGAATTTTTTCCCCGATATTCTC  4929

v.1  5251  cttctgtcaaagtcagaacaaattcagggaatttattttctggcagttgt  5300
           ||||||||||||||||||||||||||||||||||||||||||||||||||
v.4  4930  CTTCTGTCAAAGTCAGAACAAATTCAGGGAATTTATTTTCTGGCAGTTGT  4979

v.1  5301  gctccagtccttttaaaattgtacatgaacatgttttagaaacaatatgg  5350
           ||||||||||||||||||||||||||||||||||||||||||||||||||
v.4  4980  GCTCCAGTCCTTTTAAAATTGTACATGAACATGTTTTAGAAACAATATGG  5029

v.1  5351  aggatgatgcatacatgtcggtcaagttcagcgctcgacattttatggaa  5400
           ||||||||||||||||||||||||||||||||||||||||||||||||||
v.4  5030  AGGATGATGCATACATGTCGGTCAAGTTCAGCGCTCGACATTTTATGGAA  5079

v.1  5401  agatttttttaaccttaccacgaaatacttaactactgtttaagtgaatt  5450
           ||||||||||||||||||||||||||||||||||||||||||||||||||
v.4  5080  AGATTTTTTTAACCTTACCACGAAATACTTAACTACTGTTTAAGTGAATT  5129

v.1  5451  gacttatttcactttagtttttgaactgtgattattggtatactgttata  5500
           ||||||||||||||||||||||||||||||||||||||||||||||||||
v.4  5130  GACTTATTTCACTTTAGTTTTTGAACTGTGATTATTGGTATACTGTTATA  5179

v.1  5501  tcctcaacttggatttatggtaacccctttttagttcatggagaccaaaat  5550
           ||||||||||||||||||||||||||||||||||||||||||||||||||
v.4  5180  TCCTCAACTTGGATTTATGGTAACCCCTTLTAGTTCATGGAGACCAAAAT  5229

v.1  5551  ttggggtatttataatagtcagcgcaggaatgcacatggaatatctactt  5600
           ||||||||||||||||||||||||||||||||||||||||||||||||||
v.4  5230  TTCGGGTATTTATAATAGTCAGCGCAGGAATGCACATGGAATATCTACTT  5279

v.1  5601  gtccttttgaacctcacgagtcatccagaatgtatagacaggaaaagcat  5650
           ||||||||||||||||||||||||||||||||||||||||||||||||||
v.4  5280  GTCCTTTTGAACCTCACGAGTCATCCAGAATGTATAGACAGGAAAAGCAT  5329

v.1  5651  gtcttatttaaaactgtaatttatgggctcaggatctgaccgcagtcccg  5700
           ||||||||||||||||||||||||||||||||||||||||||||||||||
v.4  5330  GTCTTATTTAAAACTGTAATTTATGGGCTCAGGATCTGACCGCAGTCCCG  5379

v.1  5701  ggagtaagcatttcaaagggggaaggcagtgtggtccctaccctgtgtga  5750
           ||||||||||||||||||||||||||||||||||||||||||||||||||
v.4  5380  GGAGTAAGCATTTCAAAGGGGGAAGGCAGTGTGGTCCCTACCCTQTGTGA  5429

v.1  5751  atgtgaggatgtagacatccatcagtgcaactcgagctccatcctcctcc  5800
           ||||||||||||||||||||||||||||||||||||||||||||||||||
v.4  5430  ATGTGAGGATGTAGACATCCATCAGTGCAACTCGAGCTCCATCCTCCTCC  5479

v.1  5801  gatttctaaggctccagttttctggagggacagtcatcatgttttgattt  5850
           ||||||||||||||||||||||||||||||||||||||||||||||||||
v.4  5480  GATTTCTAAGGcTCCAGTTTTCTGGAGGGACAGTCATCATGTTTTGATTT  5529

v.1  5851  atctgggagaaaactgtggtgcacagcttgtgaggagggcaaggttgtga  5900
           ||||||||||||||||||||||||||||||||||||||||||||||||||
v.4  5530  ATCTGGGAGAAAACTGTGGTGCACAGCTTGTGAGGAGGGCAAGGTTGTGA  5579

v.1  5901  cgttcgagcttagttctggtgttattctgtctcctcttctttgtcatcag  5950
           ||||||||||||||||||||||||||||||||||||||||||||||||||
v.4  5580  CGTTCGAGCTTAGTTCTGGTGTTATTCTGTCTCCTCTTCTTTGTCATCAG  5629

v.1  5951  ccaaaacgtggtttttaaagagagtcatgcaggttagaaataatgtcaaa  6000
           ||||||||||||||||||||||||||||||||||||||||||||||||||
v.4  5630  CCAAAACGTGGTTTTTAAAGAGAGTCATGCAGGTTAGAAATAATGTCAAA  5679

v.1  6001  aatatttaggaatttaataacctttaagtcagaaactaaaacaaatactg  6050
           ||||||||||||||||||||||||||||||||||||||||||||||||||
v.4  5680  AATATTTAGGAATTTAATAACCTTTAAGTCAGAAACTAAAACAAATACTG  5729

v.1  6051  aaatattagctcttcctacacttcgtgttcccctttagctgcctgaaaat  6100
           ||||||||||||||||||||||||||||||||||||||||||||||||||
v.4  5730  AAATATTAGCTCTTCCTACACTTCGTGTTCCCCTTTAGCTGCCTGAAAAT  5779

v.1  6101  caagattgctcctactcagatcttctgagtggctaaaacttatggatatg  6150
           ||||||||||||||||||||||||||||||||||||||||||||||||||
v.4  5780  CAAGATTGCTCCTaCTCAGATCTTCTGAGTGGCTAAAACTTATGGATATG  5829
```

TABLE LIIIc-continued

Nucleotide sequence alignment of 282P1G03 v.1 (SEQ ID NO: 164) and 282P1G03 v.4 (SEQ ID NO: 165)

```
v.1  6151  aaaaatgagattgaatgatgactatgctttgctatcattgttacctttcc  6200
           ||||||||||||||||||||||||||||||||||||||||||||||||||
v.4  5830  AAAAATGAGATTGAATGATGACTATGCTTTGCTATCATTGTTACCTTTCC  5879

v.1  6201  tcaatactatttggcaactactgggactcttcagcacaaaaggaatagat  6250
           ||||||||||||||||||||||||||||||||||||||||||||||||||
v.4  5880  TCAATACTATTTGGCAACTACTGGGACTCTTCAGCACAAAAGGAATAGAT  5929

v.1  6251  ctatgattgaccctgattttaattgtgaaattatatgattcatatatttt  6300
           ||||||||||||||||||||||||||||||||||||||||||||||||||
v.4  5930  CTATGATTGACCCTGATTTTAATTGTGAAATTATATGATTCATATATTTT  5979

v.1  6301  atgaatcagaataaccttcaaataaaataaatctaagtcggttaaaatgg  6350
           ||||||||||||||||||||||||||||||||||||||||||||||||||
v.4  5980  ATGAATCAGAATAACCTTCAAATAAAATAAATCTAAGTCGGTTAAAATGG  6029

v.1  6351  atttcatgattttccctcagaaaatgagtaacggagtccacggcgtgcaa  6400
           ||||||||||||||||||||||||||||||||||||||||||||||||||
v.4  6030  ATTTCATGATTTTCCCTCAGAAAATGAGTAACgGAGTCCACGGCGTGCAA  6079

v.1  6401  tggtaattataaattggtgatgcttgtttgcaaattgcccactcgtgata  6450
           ||||||||||||||||||||||||||||||||||||||||||||||||||
v.4  6080  TGGTAATTATAAATTGGTGATGCTTGTTTGCAAATTCCCCACTCGTGATA  6129

v.1  6451  agtcaacagccaatatttaaaactttgttcgttactggctttaccctaac  6500
           ||||||||||||||||||||||||||||||||||||||||||||||||||
v.4  6130  AGTCAACAGCCAATATTTAAAACTTTGTTCGTTACTGQCTTTACCCTAAC  6179

v.1  6501  tttctctagtctactgtcaatatcattttaatgtaattgattgtatatag  6550
           ||||||||||||||||||||||||||||||||||||||||||||||||||
v.4  6180  TTTCTCTAGTCTACTGTCAATATCATTTTAATGTAATTGATTGTATATAG  6229

v.1  6551  tctcaagaatggttggtgggcatgagttcctagagaactgtccaagggtt  6600
           ||||||||||||||||||||||||||||||||||||||||||||||||||
v.4  6230  TCTCAACAATGGTTGGTGGGCATGAGTTCCTAGAGAACTGTCCAAGGGTT  6279

v.1  6601  gggaaaatccaaattctcttcctggctccagcactgattttgtacataaa  6650
           ||||||||||||||||||||||||||||||||||||||||||||||||||
v.4  6280  GGGAAAATCCAAATTCTCTTCCTGGcTCCAGCACTGATTTTGTACATAAA  6329

v.1  6651  cattaggcaggttgcttaaccttttttatttcaaactctctcaactctaaa  6700
           ||||||||||||||||||||||||||||||||||||||||||||||||||
v.4  6330  CATTAGGCAGGTTGCTTAACCTTTTTATTTCAAACTCTCTCAACTCTAAA  6379

v.1  6701  gtgctaataataatctcagttaccttatctttgtcacagggtgttctttt  6750
           ||||||||||||||||||||||||||||||||||||||||||||||||||
v.4  6380  GTGCTAATAATAATCTCAGTTACCTTATCTTTGTCACAGGGTGTTCTTTT  6429

v.1  6751  ttatgaagaaaaatttgaaaatgataaaagctaagatgccttctaacttc  6800
           ||||||||||||||||||||||||||||||||||||||||||||||||||
v.4  6430  TTATGAAGAAAAATTTGAAAATGATAAAAGCTAAGATGCCTTCTAACTTC  6479

v.1  6801  ataagcaaacctttaactaattatgtatctgaaagtcacccccacatacc  6850
           ||||||||||||||||||||||||||||||||||||||||||||||||||
v.4  6480  ATAAGCAAACCTTTAACTAATTATGTATCTGAAAGTCACCCCCACATACC  6529

v.1  6851  aactcaactttttttcctgtgaacacataaatatattttttatagaaaaaca  6900
           ||||||||||||||||||||||||||||||||||||||||||||||||||
v.4  6530  AACTCAACTTTTTTCCTGTGAACACATAAATATATTTTTATAGAAAAACA  6579

v.1  6901  aatctacataaaataaatctactgtttagtgagcagtatgacttgtacat  6950
           ||||||||||||||||||||||||||||||||||||||||||||||||||
v.4  6580  AATCTACATAAAATAAATCTACTGTTTAGTGAGCAGTATGAcTTGTACAT  6629

v.1  6951  gccattgaaaattattaatcagaagaaaattaagcagggtctttgctata  7000
           ||||||||||||||||||||||||||||||||||||||||||||||||||
v.4  6630  GCCATTGAAAATTATTAATCAGAAGAAAATTAAGCAGGGTCTTTGCTATA  6679

v.1  7001  caaaagtgttttccactaattttgcatgcgtatttataagaaaaatgtga  7050
           ||||||||||||||||||||||||||||||||||||||||||||||||||
v.4  6680  CAAAAGTGTTTTCCACTAATTTTGCATGCGTATTTATAAGAAAAATGTGA  6729

v.1  7051  atttggtggttttattctatcggtataaaggcatcgatattttagatgca  7100
           ||||||||||||||||||||||||||||||||||||||||||||||||||
v.4  6730  ATTTGGTGGTTTTATTCTATCGGTATAAAGGCATcGATATTTTAGATGCA  6779
```

TABLE LIIIc-continued

Nucleotide sequence alignment of 282P1G03 v.1 (SEQ ID NO: 164) and 282P1G03 v.4 (SEQ ID NO: 165)

```
v.1  7101 cccgtgtttgtaaaaatgtagagcacaatggaattatgctggaagtctca  7150
          ||||||||||||||||||||||||||||||||||||||||||||||||||
v.4  6780 CCCGTGTTTGTAAAAATGTAGAGCACAATGGAATTATGCTGGAAGTCTCA  6829

v.1  7151 aataatattttttcctattttatactcatggaagagataagctaaagag  7200
          ||||||||||||||||||||||||||||||||||||||||||||||||||
v.4  6830 AATAATATTTTTTCCTATTTTATACTCATGGAAGAGATAAGCTAAAGAG  6879

v.1  7201 gggacaataatgagaaatgttggtgtgcttttctaagcatttaaaacata  7250
          ||||||||||||||||||||||||||||||||||||||||||||||||||
v.4  6880 GGGACAATAATGAGAAATGTTGGTGTGCTTTTCTAAGCATTTAAAACATA  6929

v.1  7251 attgccaattgaaaccctaaatatgtttacataccattaagatatgattc  7300
          ||||||||||||||||||||||||||||||||||||||||||||||||||
v.4  6930 ATTGCCAATTGAAACCCTAAATATGTTTACATACCATTAAGATATGATTC  6979

v.1  7301 atgtaacaatgttaaattaattataatgggattgggtttgttatctgtgg  7350
          ||||||||||||||||||||||||||||||||||||||||||||||||||
v.4  6980 ATGTAACAATGTTAAATTAATTATAATGGGATTGGGTTTGTTATCTGTGG  7029

v.1  7351 tagtatatatcctagtgttcctatagtgaaataagtagggttcagccaaa  7400
          ||||||||||||||||||||||||||||||||||||||||||||||||||
v.4  7030 TAGTATATATCCTAGTGTTCCTATAGTGAATAAGTAGGGTTCAGCCAAAA  7079

v.1  7401 gctttctttgttttgtaccttaaattgttcgattacgtcatcaaaagaga  7450
          ||||||||||||||||||||||||||||||||||||||||||||||||||
v.4  7080 GCTTTCTTTGTTTTGTACCTTAAATTGTTCGATTACGTCATCAAAAGAGA  7129.

v.1  7451 tgaaaggtatgtagaacaggttcacgtgattaccttttttcttttggcttg  7500
          ||||||||||||||||||||||||||||||||||||||||||||||||||
v.4  7130 TGAAAGGTATGTAGAACAGGTTCACGTGATTACCTTTTTCTTTTGGCTTG  7179

v.1  7501 gattaatattcatagtagaactttataaaacgtgtttgtattgtaggtgg  7550
          ||||||||||||||||||||||||||||||||||||||||||||||||||
v.4  7180 GATTAATATTCATAGTAGAACTTTATAAAACGTGTTTGTATTGTAGGTGG  7229

v.1  7551 tgtttgtattatgcttatgactatgtatggtttgaaaatattttcattat  7600
          ||||||||||||||||||||||||||||||||||||||||||||||||||
v.4  7230 TGTTTGTATTATGCTTATGACTATGTATGGTTTGAAAATATTTTCATTAT  7279

v.1  7601 acatgaaattcaactttccaaataaaagttctacttcatgtaatccaaaa  7650
          ||||||||||||||||||||||||||||||||||||||||||||||||||
v.4  7280 ACATGAAATTCAACTTTCCAAATAAAAGTTCTACTTCATGTAATCCAAAA  7329
```

TABLE LIVc

Peptide sequences of protein coded by 282P1G03 v.4

```
                                                        (SEQ ID NO:166)
MEPLLLGRGL IVYLMFLLLK FSKAIEIPSS VQQVPTIIKQ SKVQVAFPFD EYFQIECEAK  60

GNPEPTFSWT KDGNPFYFTD HRIIPSNNSG TFRIPNEGHI SHFQGKYRCF ASNKLGIANS  120

EEIEFIVPSV PKLPKEKIDP LEVEEGDPIV LPCNPPKGLP PLHIYWMNIE LEHIEQDERV  180

YMSQKGDLYF ANVEEKDSRN DYCCFAAFPR LRTIVQKMPM KLTVNSLKHA NDSSSSTEIG  240

SKANSIKQRK PKLLLPPTES GSESSITILK GEILLLECFA EGLPTPQVDW NKIGGDLPKG  300

RETKENYGKT LKIENVSYQD KGNYRCTASN FLGTATHDFH VIVEEPPRWT KKPQSAVYST  360

GSNGILLCEA EGEPQPTIKW RVNGSPVDNH PFAGDVVFPR EISFTNLQPN HTAVYQCEAS  420

NVHGTILANA NIDVVDVRPL IQTKDGENYA TVVGYSAFLH CEFFASPEAV VSWQKVEEVK  480

PLEGRRYHIY ENGTLQINPT TEEDAGSYSC WVENAIGKTA VTANLDIRNA TKLRVSPKNP  540

RIPKLHMLEL HCESKCDSHL KHSLKLSWSK DGEAFEINGT EDGRIIIDGA NLTISNVTLE  600

DQGIYCCSAH TALDSAADIT QVTVLDVPDP PENIHLSERQ NRSVRLTWEA GADHNSNISE  660

YIVEFEGNKE EPGRWEELTR VQGKKTTVIL PLAPFVRYQF RVIAVNEVGR SQPSQPSDHH  720
```

TABLE LIVc-continued

| Peptide sequences of protein coded by 282P1G03 v.4 | |
|---|---|
| ETPPAAPDRN PQNIRVQASQ PKEMIIKWEP LKSMEQNGPG LEYRVTWKPQ GAPVEWEEET | 780 |
| VTNHTLRVMT PAVYAPYDVK VQAINQLGSG PDPQSVTLYS GEDLPEQPTF LKVIKVDKDT | 840 |
| ATLSWGLPKK LNGNLTGYLL QYQIINDTYE IGELNDINIT TPSKPSWHLS NINATTKYKF | 900 |
| YLRACTSQGC GKPITEESST LGEGSKGIGK ISGVNLTQKT HPIEVFEPGA EHIVRIMTKH | 960 |
| WGDNDSIFQD VIETRGREYA GLYDDISTQG WFIGLMCAIA LLTLLLLTVC FVKRNRGGKY | 1020 |
| SVKEKEDLHP DPEIQSVKDE TFGEYSDSDE KPLKGSLRSL NRDMQPTESA DSLVEYGEGD | 1080 |
| HGLFSEDGSF LGAYAGSKEK GSVESNGSST ATFPLRA 1117 | |

TABLE LVc

Amino acid sequence alignment of 282P1G03 v.1 (SEQ ID NO: 167) and 282P1G03 v.4 (SEQ ID NO: 168)

```
v.1    1  MEPLLLGRGLIVYLMFLLLKFSKAIEIPSSVQQVPTIIKQSKVQVAFPFD  50
          ||||||||||||||||||||||||||||||||||||||||||||||||||
v.4    1  MEPLLLGRGLIVYLMFLLLKFSKAIEIPSSVQQVPTIIKQSKVQVAFPFD  50

v.1   51  EYFQIECEAKGNPEPTFSWTKDGNPFYFTDHRIIPSNNSGTFRIPNEGHI  100
          ||||||||||||||||||||||||||||||||||||||||||||||||||
v.4   51  EYFQIECEAKGNPEPTFSWTKDGNPFYFTDHRIIPSNNSGTFRIPNEGHI  100

v.1  101  SHFQGKYRCFASNKLGIAMSEEIEFIVPSVPKLPKEKIDPLEVEEGDPIV  150
          ||||||||||||||||||||||||||||||||||||||||||||||||||
v.4  101  SHFQGKYRCFASNKLGIAMSEEIEFIVPSVPKLPKEKIDPLEVEEGDPIV  150

v.1  151  LPCNPPKGLPPLHIYWMNIELEHIEQDERVYMSQKGDLYFANVEEKDSRN  200
          ||||||||||||||||||||||||||||||||||||||||||||||||||
v.4  151  LPCNPPKGLPPLHIYWMNIELEHIEQDERVYMSQKGDLYFANVEEKDSRN  200

v.1  201  DYCCFAAFPRLRTIVQKMPMKLTVNSLKHANDSSSSTEIGSKANSIKQRK  250
          ||||||||||||||||||||||||||||||||||||||||||||||||||
v.4  201  DYCCFAAFPRLRTIVQKMPMKLTVNSLKHANDSSSSTEIGSKANSIKQRK  250

v.1  251  PKLLLPPTESGSESSITILKGEILLLECFAEGLPTPQVDWNKTGGDLPKG  300
          ||||||||||||||||||||||||||||||||||||||||||||||||||
v.4  251  PKILLPPTESGSESSITILKGEILLLECFAEGLPTPQVDWNKIGGDLPKG  300

v.1  301  RETKENYGKTLKIENVSYQDKGNYRCTASNFLGTATHDFHVIVEEPPRWT  350
          ||||||||||||||||||||||||||||||||||||||||||||||||||
v.4  301  RETKENYGKTLKIENVSYQDKGNYRCTASNFLGTATHDFHVIVEEPPRWT  350

v.1  351  KKPQSAVYSTGSNGILLCEAEGEPQPTIKWRVHGSPVDNHPFAGDVVFPR  400
          ||||||||||||||||||||||||||||||||||||||||||||||||||
v.4  351  KKPQSAVYSTGSNGILLCEAEGEPQPTIKWRVHGSPVDNHPFAGDVVFPR  400

v.1  401  EISFTNLQPNHTAVYQCEASNVHGTILANANIDVVDVRPLIQTKDGENYA  450
          ||||||||||||||||||||||||||||||||||||||||||||||||||
v.4  401  EISFTNLQPNHTAVYQCEASNVHGTILANANIDVVDVRPLIQTKDGENYA  450

v.1  451  TVVGYSAFLHCEFFASPEAVVSWQKVEEVKPLEGRRYHIYENGTLQINRT  500
          ||||||||||||||||||||||||||||||||||||||||||||||||||
v.4  451  TVVGYSAFLHCEFFASPEAVVSWQKVEEVKPLEGRRYHIYENGTLQINRT  500

v.1  501  TEEDAGSYSCWVENAIGKTAVTANLDIRNATKLRVSPKNPRIPKLHMLEL  550
          ||||||||||||||||||||||||||||||||||||||||||||||||||
v.4  501  TEEDAGSYSCWVEMAIGKTAVTANLDIRNATKLRVSPKHPRIPKLHMLEL  550

v.1  551  HCESKCDSHLKHSLKLSWSKDGEAFEThGTEDGRIIIDGANLTISNVTLE  600
          ||||||||||||||||||||||||||||||||||||||||||||||||||
v.4  551  HCESKCDSHLKHSLKLSWSKDGEAFEINGTEDGRIIIDGANLTISNVTLE  600

v.1  601  DQGIYCCSAHTALDSAADITQVTVLDVPDPPENLHLSERQNRSVRLTWEA  650
          ||||||||||||||||||||||||||||||||||||||||||||||||||
v.4  601  DQGIYCCSAHTALDSAADITQVTVLDVPDPPENLHLSERQNRSVRLTWEA  650

v.1  651  GADHNSNISEYIVEFEGNKEEPGRWEELTRVQGKKTTVILPLAPFVRYQF  700
          ||||||||||||||||||||||||||||||||||||||||||||||||||
v.4  651  GADHNSNISEYIVEFEGNKEEPGRWEELTRVQGKKTTVILPLAPFVRYQF  700
```

TABLE LVc-continued

Amino acid sequence alignment of 282P1G03 v.1 (SEQ ID NO: 167) and 282P1G03 v.4 (SEQ ID NO: 168)

```
v.1   701 RVIAVNEVGRSQPSQPSDHHETPPAAPDRNPQNIRVQASQPKEMIIKWEP  750
          ||||||||||||||||||||||||||||||||||||||||||||||||||
v.4   701 RVIAVNEVGRSQPSQPSDHHETPPAAPDRNPQNIRVQASQPKEMIIKWEP  750

v.1   751 LKSMEQNGPGLEYRVTWKPQGAPVEWEEETVTNHTLRVMTPAVYAPYDVK  800
          ||||||||||||||||||||||||||||||||||||||||||||||||||
v.4   751 LKSMEQNGPGLEYRVTWKPQGAPVEWEEETVTNHTLRVMTPAVYAPYDVK  800

v.1   801 VQAINQLGSGPDPQSVTLYSGEDYPDTAPVIHGVDVINSTLVKVTWSTVP  850
          |||||||||||||||||||||||
v.4   801 VQAIMQLGSGPDPQSVTLYSGED---------------------------  823

v.1   851 KDRVHGRLKGYQTNWWKTKSLLDGRTHPKEVNILRFSGQRNSGMVPSLDA  900

v.4   824 --------------------------------------------------  823

v.1   901 FSEFHLTVLAYNSKGAGPESEPYIFQTPEGVPEQPTFLKVIKVDKDTATL  950
                                         :|||||||||||||||||||
v.4   824 ------------------------------LPEQPTFLKVIKVDKDTATL  843

v.1   951 SWGLPKKLNGNLTGYLLQYQIINDTYEIGELNDINITTPSKPSWHLSNLN  1000
          ||||||||||||||||||||||||||||||||||||||||||||||||||
v.4   844 SWGLPKKLNGNLTGYLLQYQIINDTYEIGELNDINITTPSKPSWHLSNLN  893

v.1  1001 ATTKYKFYLRACTSQGCGKPITEESSTLGEGSKGIGKISGVNLTQKTHPI  1050
          ||||||||||||||||||||||||||||||||||||||||||||||||||
v.4   894 ATTKYKFYLPACTSQGCGKPITEESSTLGEGSKGIGKISGVNLTQKTHPI  943

v.1  1051 EVFEPGAEHIVRLMTKNWGDNDSIFQDVIETRGREYAGLYDDISTQGWPI  1100
          ||||||||||||||||||||||||||||||||||||||||||||||||||
v.4   944 EVFEPGAEHIVRLMTKNWGDNDSIFQDVIETRGREYAGLYDDISTQGWFI  993

v.1  1101 GLMCAIALLTLLLLTVCFVKRHRGGKYSVKEKEDLHPDPEIQSVKDETFG  1150
          ||||||||||||||||||||||||||||||||||||||||||||||||||
v.4   994 GLMCAIALLTLLLLTVCFVKRNRGGKYSVKEKEDLHPDPEIQSVKDETFG  1043

v.1  1151 EYSDSDEKPLKGSLRSLNRDMQPTESADSLVEYGEGDHGLFSEDGSFIGA  1200
          ||||||||||||||||||||||||||||||||||||||||||||||||||
v.4  1044 EYSDSDEKPLKGSLRSLNRDMQPTESADSLVEYGEGDHGLFSEDGSFIGA  1093

v.1  1201 YAGSKEKGSVESHGSSTATFPLRA 1224
          ||||||||||||||||||||||||
v.4  1094 YAGSKEKGSVESNGSSTATFPLRA 1117
```

TABLE LIId

Nucleotide sequence of transcript variant 282P1G03 v.5

(SEQ ID NO:169)

```
cggaccctgc gcgcccccgt cccggctccc ggccggctcg ggggagaagg cgcccgaggg  60

gaggcgccgg acagatcgcg tttcggaggc ggcgcaggtg ctgtaaactg caaaccataa  120

tcctgtctta atactgcaaa caaatcatag tggaactaag ggaacttaa tttactgttt  180

ccaggttaac taaggtctca gctgtaaacc aaaagtgaga ggagacatta agattttcat  240

tcttaccggg ttgtcttctt cctgaagagc aatggagccg cttttacttg gaagaggact  300

aatcgtatat ctaatgttcc tcctgttaaa attctcaaaa gcaattgaaa taccatcttc  360

agttcaacag gttccaacaa tcataaaaca gtcaaaagtc caagttgcct ttcccttcga  420

tgagtatttt caaattgaat gtgaagctaa aggaaatcca gaaccaacat tttcgtggac  480

taaggatggc aacccttttt atttcactga ccatcggata attccatcga acaattcagg  540

aacattcagg atcccaaacg aggggcacat atctcacttt caagggaaat accgctgctt  600

tgcttcaaat aaactgggaa tcgctatgtc agaagaaata gaatttatag ttccaagtgt  660

tccaaaactc ccaaaagaaa aaattgaccc tcttgaagtg gaggagggag atccaattgt  720
```

TABLE LIId-continued

| Nucleotide sequence of transcript variant 282P1G03 v.5 |
|---|
| cctcccatgc aatcctccca aaggcctccc acctttacac atttattgga tgaatattga 780 |
| attagaacac atcgaacaag atgaaagagt atacatgagc caaaagggag atctatactt 840 |
| cgcaaacgtg gaagaaaagg acagtcgcaa tgactactgt tgctttgctg catttccaag 900 |
| attaaggact attgtacaga aaatgccaat gaaactaaca gttaacagtt caaattccat 960 |
| caagcaaaga aaacccaaac tgctgttgcc tcccactgag agtggcagtg agtcttcaat 1020 |
| taccatcctc aaaggggaaa tcttgctgct tgagtgtttt gctgaaggct tgccaactcc 1080 |
| acaggttgat tggaacaaaa ttggtggtga cttaccaaag gggagagaaa caaaagaaaa 1140 |
| ttatggcaag actttgaaga tagagaatgt ctcctaccag gacaaaggaa attatcgctg 1200 |
| cacagccagc aatttcttgg gaacagccac tcacgatttt cacgttatag tagaagagcc 1260 |
| tcctcgctgg acaaagaagc ctcagagtgc tgtgtatagc accggaagca atggcatctt 1320 |
| gttatgtgag gctgaaggag aacctcaacc cacaatcaag tggagagtca atggctcccc 1380 |
| agttgacaat catccatttg ctggtgatgt tgtcttcccc agggaaatca gttttaccaa 1440 |
| ccttcaacca aatcatactg ctgtgtacca gtgtgaagcc tcaaatgtcc atggaactat 1500 |
| ccttgccaat gccaatattg atgttgtgga tgtccgtcca ttgatacaaa ccaaagatgg 1560 |
| agaaaattac gctacagtgg ttgggtacag tgctttctta cattgcgagt tctttgcttc 1620 |
| acctgaggca gtcgtgtcct ggcagaaggt ggaagaagtg aaacccctgg agggcaggcg 1680 |
| gtatcatatc tatgaaaatg gcacattgca gatcaacaga accaccgaag aagatgctgg 1740 |
| gtcttactca tgttgggtag aaaatgctat aggaaaaact gcagtcacag ccaatttgga 1800 |
| tattagaaat gctacaaaac ttagagtttc tcctaagaat cctcgtatcc ccaaattgca 1860 |
| tatgcttgaa ttacattgtg aaagcaaatg tgactcacat ttgaaacaca gtttgaagtt 1920 |
| gtcctggagt aaagatggag aagcctttga aattaatggc acagaagatg gcaggataat 1980 |
| tattgatgga gctaatttga ccatatctaa tgtaacttta gaggaccaag gtatttactg 2040 |
| ctgttcagct catactgctc tagacagtgc tgccgatata actcaagtaa ctgttcttga 2100 |
| tgttccggat ccaccagaaa accttcactt gtctgaaaga cagaacagga gtgttcggct 2160 |
| gacctgggaa gctggagctg accacaacag caatattagc gagtatattg ttgaatttga 2220 |
| aggaaacaaa gaagagcctg gaaggtggga ggaactgacc agagtccaag gaaagaaaac 2280 |
| cacagttatc ttacctttgg ctccatttgt gagataccag ttcagggtca tagccgtgaa 2340 |
| cgaagtaggg agaagtcagc ctagccagcc gtcagaccat catgaaacac caccagcagc 2400 |
| tccagatagg aatccacaaa acataagggt tcaagcctct caacccaagg aaatgattat 2460 |
| aaagtgggag cctttgaaat ccatggagca gaatggacca ggcctagagt acagagtgac 2520 |
| ctggaagcca cagggagccc cagtggagtg ggaagaagaa acagtcacaa accacacatt 2580 |
| gcgggtgatg acgcctgctg tctatgcccc ttatgatgtc aaggtccagg ctatcaatca 2640 |
| actaggatct gggcctgacc ctcagtcagt gactctctat tctggagaag actatcctga 2700 |
| tacagctcca gtgatccatg gggtggacgt tataaacagt acattagtta aagttacctg 2760 |
| gtcaacagtt ccaaaggaca gagtacatgg acgtctgaaa ggctatcaga taaattggtg 2820 |
| gaaaacaaaa agtctgttgg atggaagaac acatcccaaa gaagtgaaca ttctaagatt 2880 |
| ttcaggacaa agaaactctg gaatggttcc ttccttagat gcctttagtg aatttcattt 2940 |
| aacagtctta gcctataact ctaaaggagc tggtcctgaa agtgagcctt atatatttca 3000 |

TABLE LIId-continued

| Nucleotide sequence of transcript variant 282P1G03 v.5 |
|---|
| aacaccagaa ggagtacctg aacagccaac ttttctaaag gtcatcaaag ttgataaaga 3060 |
| cactgccact ttatcttggg gactacctaa gaaattaaat ggaaacttaa ctggctatct 3120 |
| tttgcaatat cagataataa atgacaccta cgagattgga gaattaaatg atattaacat 3180 |
| tacaactcca tcaaagccca gctggcacct ctcaaacctg aatgcaacta ccaagtacaa 3240 |
| attctacttg agggcttgca cttcacaggg ctgtggaaaa ccgatcacgg aggaaagctc 3300 |
| caccttagga gaagggagta aaggtatcgg gaagatatca ggagtaaatc ttactcaaaa 3360 |
| gactcaccca atagaggtat ttgagccggg agctgaacat atagttcgcc taatgactaa 3420 |
| gaattggggc gataacgata gcatttttca agatgtaatt gagacaagag ggagagaata 3480 |
| tgctggttta tatgatgaca tctccactca aggctggttt attggactga tgtgtgcgat 3540 |
| tgctcttctc acactactat tattaactgt ttgctttgtg aagaggaata gaggtggaaa 3600 |
| gtactcagtt aaagaaaagg aagatttgca tccagaccca gaaattcagt cagtaaaaga 3660 |
| tgaaaccttt ggtgaataca gtgacagtga tgaaaagcct ctcaaaggaa gccttcggtc 3720 |
| ccttaatagg gatatgcagc ctactgaaag tgctgacagc ttagtcgaat acggagaggg 3780 |
| agaccatggt ctcttcagtg aagatggatc atttattggt gcctacgctg gatctaagga 3840 |
| gaagggatct gttgaaagca atggaagttc tacagcaact tttccccttc gggcataaac 3900 |
| acaacatatg taagcaacgc tactggttca ccccaacctt ccatatttat ctgttcaaag 3960 |
| gagcaagaac tttcatatag gaatagaaac atgctggccg aagatttcat ccagaagtca 4020 |
| acatcctgca attatgttga aaagagtagt actttcttca aaatataaaa tgccaagcac 4080 |
| ttcaggccta tgttttgctt atattgtttt caggtgctca aaatgcaaaa cacaaaacaa 4140 |
| atcctgcatt tagatacacc tcaactaaat ccaaagtccc cattcagtat attccatatt 4200 |
| tgcctgattt tactattcgg tgtgtttgca tagatgttgc tacttggtgg gtttttctcc 4260 |
| gtatgcacat tggtatacag tctctgagaa ctggcttggt gactttgctt cactacaggt 4320 |
| taaaagacca taagcaaact ggttatttaa aatgtaaaaa ggaatatgaa agtcttatta 4380 |
| aaacacttca ttgaaaatat acagtctaaa tttattattt aaattttact agcaaaagtc 4440 |
| ttaggtgaac aatcaactag tatttgttga gctcctattt gcccagagat ggtcatattt 4500 |
| aaacagaagt atacgttttt cagtttcaac atgaattttt ttatttctgt cagttatgac 4560 |
| atccacgagc atcacttttt gtgtctgttt tttttttttt cttggactaa attcaactgc 4620 |
| atggaagcgg tggtcagaag gttgttttat acgagaacag gcagaaagtg cccattgttc 4680 |
| aggattctaa tagctacatc tacttaatat cttcatttct aaattgactg cttttacctt 4740 |
| tttctcatgt ttatataatg gtatgcttgc atatatttca tgaatacatt gtacatatta 4800 |
| tgttaatatt tacacaattt aaaatataga tgtgttttat tttgaagtga gaaaatgaac 4860 |
| attaacaggc atgtttgtac agctagaata tattagtaag atactgtttt tcgtcattcc 4920 |
| agagctacaa ctaataacac gaggttccaa agctgaagac tttgtataaa gtatttgggt 4980 |
| tttgttcttg tattgctttc tttcaacagt ttcaaaataa aatatcatac aaatattgag 5040 |
| ggaaatgttt tcatattttt caaaataggt ttttattgtt gaatgtacat ctaccccagc 5100 |
| ccctcaaaag aaaaactgtt tacatagaaa ttcctacaca tacgtttgcg tatatgttat 5160 |
| tttaaacatc tttgtggtga gaattttttc cccgatattc tccttctgtc aaagtcagaa 5220 |
| caaattcagg gaatttattt tctggcagtt gtgctccagt ccttttaaaa ttgtacatga 5280 |
| acatgtttta gaaacaatat ggaggatgat gcatacatgt cggtcaagtt cagcgctcga 5340 |

TABLE LIId-continued

| Nucleotide sequence of transcript variant 282P1G03 v.5 |
|---|
| cattttatgg aaagattttt ttaaccttac cacgaaatac ttaactactg tttaagtgaa 5400 |
| ttgacttatt tcactttagt ttttgaactg tgattattgg tatactgtta tatcctcaac 5460 |
| ttggatttat ggtaacccct tttagttcat ggagaccaaa atttggggta tttataatag 5520 |
| tcagcgcagg aatgcacatg gaatatctac ttgtcctttt gaacctcacg agtcatccag 5580 |
| aatgtataga caggaaaagc atgtcttatt taaaactgta atttatgggc tcaggatctg 5640 |
| accgcagtcc cgggagtaag catttcaaag ggggaaggca gtgtggtccc taccctgtgt 5700 |
| gaatgtgagg atgtagacat ccatcagtgc aactcgagct ccatcctcct ccgatttcta 5760 |
| aggctccagt tttctggagg gacagtcatc atgttttgat ttatctggga gaaaactgtg 5820 |
| gtgcacagct tgtgaggagg gcaaggttgt gacgttcgag cttagttctg gtgttattct 5880 |
| gtctcctctt ctttgtcatc agccaaaacg tggtttttaa agagagtcat gcaggttaga 5940 |
| aataatgtca aaaatattta ggaatttaat aacctttaag tcagaaacta aaacaaatac 6000 |
| tgaaatatta gctcttccta cacttcgtgt tccccttag ctgcctgaaa atcaagattg 6060 |
| ctcctactca gatcttctga gtggctaaaa cttatggata tgaaaaatga gattgaatga 6120 |
| tgactatgct ttgctatcat tgttaccttt cctcaatact atttggcaac tactgggact 6180 |
| cttcagcaca aaaggaatag atctatgatt gaccctgatt ttaattgtga aattatatga 6240 |
| ttcatatatt ttatgaatca gaataacctt caaataaaat aaatctaagt cggttaaaat 6300 |
| ggatttcatg attttccctc agaaaatgag taacggagtc cacggcgtgc aatggtaatt 6360 |
| ataaattggt gatgcttgtt tgcaaattgc ccactcgtga taagtcaaca gccaatattt 6420 |
| aaaactttgt tcgttactgg ctttacccta actttctcta gtctactgtc aatatcattt 6480 |
| taatgtaatt gattgtatat agtctcaaga atggttggtg ggcatgagtt cctagagaac 6540 |
| tgtccaaggg ttgggaaaat ccaaattctc ttcctggctc cagcactgat tttgtacata 6600 |
| aacattaggc aggttgctta accttttat ttcaaactct ctcaactcta aagtgctaat 6660 |
| aataatctca gttaccttat ctttgtcaca gggtgttctt ttttatgaag aaaaatttga 6720 |
| aaatgataaa agctaagatg ccttctaact tcataagcaa acctttaact aattatgtat 6780 |
| ctgaaagtca cccccacata ccaactcaac tttttcctg tgaacacata aatatatttt 6840 |
| tatagaaaaa caaatctaca taaaataaat ctactgttta gtgagcagta tgacttgtac 6900 |
| atgccattga aaattattaa tcagaagaaa attaagcagg gtctttgcta tacaaaagtg 6960 |
| ttttccacta attttgcatg cgtatttata agaaaaatgt gaatttggtg gttttattct 7020 |
| atcggtataa aggcatcgat attttagatg cacccgtgtt tgtaaaaatg tagagcacaa 7080 |
| tggaattaty ctggaagtct caaataatat ttttttccta ttttatactc atggaagaga 7140 |
| taagctaaag aggggacaat aatgagaaat gttggtgtgc ttttctaagc atttaaaaca 7200 |
| taattgccaa ttgaaaccct aaatatgttt acataccatt aagatatgat tcatgtaaca 7260 |
| atgttaaatt aattataatg ggattgggtt tgttatctgt ggtagtatat atcctagtgt 7320 |
| tcctatagtg aaataagtag ggttcagcca aagctttctt tgttttgtac cttaaattgt 7380 |
| tcgattacgt catcaaaaga gatgaaaggt atgtagaaca ggttcacgtg attacctttt 7440 |
| tcttttggct tggattaata ttcatagtag aactttataa aacgtgtttg tattgtaggt 7500 |
| ggtgtttgta ttatgcttat gactatgtat ggtttgaaaa tattttcatt atacatgttc 7560 |
| ttcaactttc caaataaaag ttctacttca tgtaatccaa aa 7602 |

TABLE LIIId

Nucleotide sequence alignment of 282P1G03 v.1 (SEQ ID NO: 170) and 282P1G03 v.5 (SEQ ID NO: 171)

```
v.1    1  cggaccctgcgcgcccccgtcccggctcccggccggctcgggggagaagg  50
          ||||||||||||||||||||||||||||||||||||||||||||||||||
v.5    1  CGGACCCTGCGCGCCCCCGTCCCGGCTCCCGGCCGGCTCGGGGGAGAAGG  50

v.1   51  cgcccgagggaggcgccggacagatcgcgtttcggaggcggcgcaggtg  100
          ||||||||||||||||||||||||||||||||||||||||||||||||||
v.5   51  CGCCCGAGGGGAGGCGCCGGACAGATCGCGTTTCGGAGGcGGCGCAGGTG  100

v.1  101  ctgtaaactgcaaaccataatcctgtcttaatactgcaaacaaatcatag  150
          ||||||||||||||||||||||||||||||||||||||||||||||||||
v.5  101  CTGTAAACTGCAPACCATAATCCTGTCTTAATACTGCAAACAAATCATAG  150

v.1  151  tggaactaaggggaacttaatttactgtttccaggttaactaaggtctca  200
          ||||||||||||||||||||||||||||||||||||||||||||||||||
v.5  151  TGGAACTAAGGGGAACTTAATTTACTGTTTCCAGGTTAACTAAGGTCTCA  200

v.1  201  gctgtaaaccaaaagtgagaggagacattaagattttcattcttaccggg  250
          ||||||||||||||||||||||||||||||||||||||||||||||||||
v.5  201  GCTGTAAACCAAAAGTGAGAGGAGACATTAAGATTTTCATTCTTACCGGG  250

v.1  251  ttgtcttcttcctgaagagcaatggagccgcttttacttggaagaggact  300
          ||||||||||||||||||||||||||||||||||||||||||||||||||
v.5  251  TTGTCTTCTTCCTGAAGAGCAATGGAGCCGCTTTTACTTGGAAGAGGACT  300

v.1  301  aatcgtatatctaatgttcctcctgttaaaattctcaaaagcaattgaaa  350
          ||||||||||||||||||||||||||||||||||||||||||||||||||
v.5  301  AATCGTATATCTAATGTTCCTCCTGTTAAAATTCTCAAAAGCAATTGAAA  350

v.1  351  taccatcttcagttcaacaggttccaacaatcataaaacagtcaaaagtc  400
          ||||||||||||||||||||||||||||||||||||||||||||||||||
v.5  351  TACCATCTTCAGTTCAACAGGTTCCAACAATCATAAAACAGTCAAAAGTC  400

v.1  401  caagttgcctttcccttcgatgagtattttcaaattgaatgtgaagctaa  450
          ||||||||||||||||||||||||||||||||||||||||||||||||||
v.5  401  CAAGTTGCCTTTCCCTTCGATGAGTATTTTCAAATTGAATGTGAAGCTAA  450

v.1  451  aggaaatccagaaccaacattttcgtggactaaggatggcaacccctttt  500
          ||||||||||||||||||||||||||||||||||||||||||||||||||
v.5  451  AGGAAATCCAGAACCAACATTTTCGTGGACTAAGGATGGCAACCCCTTTT  500

v.1  501  atttcactgaccatcggataattccatcgaacaattcaggaacattcagg  550
          ||||||||||||||||||||||||||||||||||||||||||||||||||
v.5  501  ATTTCACTGACCATCGGATAATTCCATCGAACAATTCAGGAACATTCAGG  550

v.1  551  atcccaaacgaggggcacatatctcactttcaagggaaataccgctgctt  600
          ||||||||||||||||||||||||||||||||||||||||||||||||||
v.5  551  ATCCCAAACGAGGGGCACATATCTCACTTTCAAGGGAAATACCGCTGCTT  600

v.1  601  tgcttcaaataaactgggaatcgctatgtcagaagaaatagaatttatag  650
          ||||||||||||||||||||||||||||||||||||||||||||||||||
v.5  601  TGCTTCAAATAAACTGGGAATCGCTATGTCAGAAGAAATAGAATTTATAG  650

v.1  651  ttccaagtgttccaaaactcccaaaagaaaaaattgaccctcttgaagtg  700
          ||||||||||||||||||||||||||||||||||||||||||||||||||
v.5  651  TTCCAAGTGTTCCAAAAcTCCCAAAAGAAAAAATTGACCCTCTTGAAGTG  700

v.1  701  gaggagggagatccaattgtcctcccatgcaatcctcccaaaggcctccc  750
          ||||||||||||||||||||||||||||||||||||||||||||||||||
v.5  701  GAGGAGGGAGATCCAATTGTCCTCCCATGCAATCCTCCCAAAGGCCTCCC  750

v.1  751  acctttacacatttattggatgaatattgaattagaacacatcgaacaag  800
          ||||||||||||||||||||||||||||||||||||||||||||||||||
v.5  751  ACCTTTACACATTTATTGGATGAATATTGAATTAGAACACATCGAACAAG  800

v.1  801  atgaaagagtatacatgagccaaaagggagatctatacttcgcaaacgtg  850
          ||||||||||||||||||||||||||||||||||||||||||||||||||
v.5  801  ATGAAAGAGTATACATGAGCCAAAAGGGAGATCTATACTTCGCAAACGTG  850

v.1  851  gaagaaaaggacagtcgcaatgactactgttgctttgctgcatttccaag  900
          ||||||||||||||||||||||||||||||||||||||||||||||||||
v.5  851  GAAGAAAAGGACAGTCGCAATGACTACTGTTGCTTTGCTGCATTTCCAAG  900

v.1  901  attaaggactattgtacagaaaatgccaatgaaactaacagttaacagtt  950
          ||||||||||||||||||||||||||||||||||||||||||||||||||
v.5  901  ATTAAGGACTATTGTACAGAAAATGCCAATGAAACTAACAGTTAACAGTT  950
```

TABLE LIIId-continued

Nucleotide sequence alignment of 282P1G03 v.1 (SEQ ID NO: 170) and 282P1G03 v.5 (SEQ ID NO: 171)

```
v.1   951  taaagcatgctaatgactcaagttcatccacagaaattggttccaaggca  1000
                                                             ||
v.5   951  ------------------------------------------------CA  952

v.1  1001  aattccatcaagcaaagaaaacccaaactgctgttgcctcccactgagag  1050
           ||||||||||||||||||||||||||||||||||||||||||||||||||
v.5   953  AATTCCATCAAGCAAAGAAAACCCAAACTGCTGTTGCCTCCCACTGAGAG  1002

v.1  1051  tggcagtgagtcttcaattaccatcctcaaaggggaaatcttgctgcttg  1100
           ||||||||||||||||||||||||||||||||||||||||||||||||||
v.5  1003  TGGCAGTGAGTCTTCAATTACCATCCTCAAAGGGGAAATCTTGCTGCTTG  1052

v.1  1101  agtgttttgctgaaggcttgccaactccacaggttgattggaacaaaatt  1150
           ||||||||||||||||||||||||||||||||||||||||||||||||||
v.5  1053  AGTCTTTTGCTGAAGGCTTGCCAACTCCACAGGTTGATTGGAACAAAATT  1102

v.1  1151  ggtggtgacttaccaaaggggagagaaacaaaagaaaattatggcaagac  1200
           ||||||||||||||||||||||||||||||||||||||||||||||||||
v.5  1103  GGTGGTGACTTACCAAAGGGGAGAGAAACAAAAGAAAATTATGGCAAGAC  1152

v.1  1201  tttgaagatagagaatgtctcctaccaggacaaaggaaattatcgctgca  1250
           ||||||||||||||||||||||||||||||||||||||||||||||||||
v.5  1153  TTTGAAGATAGAGAATGTCTCCTACCAGGACAAAGGAAATTATCGCTGCA  1202

v.1  1251  cagccagcaatttcttgggaacagccactcacgattttcacgttatagta  1300
           ||||||||||||||||||||||||||||||||||||||||||||||||||
v.5  1203  CAGCCAGCAATTTCTTGGGAACAGCCACTCACGATTTTCACGTTATAGTA  1252

v.1  1301  gaagagcctcctcgctggacaaagaagcctcagagtgctgtgtatagcac  1350
           ||||||||||||||||||||||||||||||||||||||||||||||||||
v.5  1253  GAAGAGCCTCCTCGCTGGACAAAGAAGCCTCAGAGTGCTGTGTATAGCAC  1302

v.1  1351  cggaagcaatggcatcttgttatgtgaggctgaaggagaacctcaaccca  1400
           ||||||||||||||||||||||||||||||||||||||||||||||||||
v.5  1303  CCGAAGCAATGGCATCTTGTTATGTGAGGCTGAAGGAGAACCTCAACCCA  1352

v.1  1401  caatcaagtggagagtcaatggctccccagttgacaatcatccatttgct  1450
           ||||||||||||||||||||||||||||||||||||||||||||||||||
v.5  1353  CAATCAAGTGGAGAGTCAATGGCTCCCCAGTTGACAATCATCCATTTGCT  1402

v.1  1451  ggtgatgttgtcttccccagggaaatcagttttaccaaccttcaaccaaa  1500
           ||||||||||||||||||||||||||||||||||||||||||||||||||
v.5  1403  GGTGATGTTGTCTTCCCCAGGGAAATCAGTTTTACCAACCTTCAACCAAA  1452

v.1  1501  tcatactgctgtgtaccagtgtgaagcctcaaatgtccatggaactatcc  1550
           ||||||||||||||||||||||||||||||||||||||||||||||||||
v.5  1453  TCATACTGCTGTGTACCAGTGTGAAGCCTCAAATGTCCATGGAACTATCC  1502

v.1  1551  ttgccaatgccaatattgatgttgtggatgtccgtccattgatacaaacc  1600
           ||||||||||||||||||||||||||||||||||||||||||||||||||
v.5  1503  TTGCCAATGCCAATATTGATGTTGTGGATGTCCGTCCATTGATACAAACC  1552

v.1  1601  aaagatggagaaaattacgctacagtggttgggtacagtgctttcttaca  1650
           ||||||||||||||||||||||||||||||||||||||||||||||||||
v.5  1553  AAAGATGGAGAAAATTACGCTACAGTGGTTGGGTACAGTGCTTTCTTACA  1602

v.1  1651  ttgcgagttctttgcttcacctgaggcagtcgtgtcctggcagaaggtgg  1700
           ||||||||||||||||||||||||||||||||||||||||||||||||||
v.5  1603  TTGCGAGTTCTTTGCTTCACCTGAGGCAGTCGTGTCCTGGCAGAAGGTGG  1652

v.1  1701  aagaagtgaaacccctggagggcaggcggtatcatatctatgaaaatggc  1750
           ||||||||||||||||||||||||||||||||||||||||||||||||||
v.5  1653  AAGAAGTGAAACCCCTGGAGGGCAGGCGGTATCATATCTATGAAAATGGC  1702

v.1  1751  acattgcagatcaacagaaccaccgaagaagatgctgggtcttactcatg  1800
           ||||||||||||||||||||||||||||||||||||||||||||||||||
v.5  1703  ACATTGCAGATCAACAGAACCACCGAAGAAGATGCTGGGTCTTACTCATG  1752

v.1  1801  ttgggtagaaaatgctataggaaaaactgcagtcacagccaatttggata  1850
           ||||||||||||||||||||||||||||||||||||||||||||||||||
v.5  1753  TTGGGTAGAAAATGCTATAGGAAAAACTGCAGTCACAGCCAATTTGGATA  1802

v.1  1851  ttagaaatgctacaaaacttagagtttctcctaagaatcctcgtatcccc  1900
           ||||||||||||||||||||||||||||||||||||||||||||||||||
v.5  1803  TTAGAAATGCTACAAAACTTAGAGTTTCTCCTAAGAATCCTCGTATCCCC  1852
```

TABLE LIIId-continued

Nucleotide sequence alignment of 282P1G03 v.1 (SEQ ID NO: 170) and 282P1G03 v.5 (SEQ ID NO: 171)

| | | | |
|---|---|---|---|
| v.1 | 1901 | aaattgcatatgcttgaattacattgtgaaagcaaatgtgactcacattt | 1950 |
| v.5 | 1853 | AAATTGCATATGCTTGAATTACATTGTGAAAGCAAATGTGACTCACATTT | 1902 |
| v.1 | 1951 | gaaacacagtttgaagttgtcctggagtaaagatggagaagcctttgaaa | 2000 |
| v.5 | 1903 | GAAACACAGTTTGAAGTTGTCCTGGAGTAAAGATGGAGAAGCCTTTGAAA | 1952 |
| v.1 | 2001 | ttaatggcacagaagatggcaggataattattgatggagctaatttgacc | 2050 |
| v.5 | 1953 | TTAATGGCACAGAAGATGGCAGGATAATTATTGATGGAGCTPATTTGACC | 2002 |
| v.1 | 2051 | atatctaatgtaactttagaggaccaaggtatttactgctgttcagctca | 2100 |
| v.5 | 2003 | ATATCTAATGTAACTTTAGAGGACCAAGGTATTTACTGCTGTTCAGCTCA | 2052 |
| v.1 | 2101 | tactgctctagacagtgctgccgatataactcaagtaactgttcttgatg | 2150 |
| v.5 | 2053 | TACTGCTCTAGACAGTGCTGCCGATATAACTCAAGTPACTGTTCTTGATG | 2102 |
| v.1 | 2151 | ttccggatccaccagaaaaccttcacttgtctgaaagacagaacaggagt | 2200 |
| v.5 | 2103 | TTCCGGATCCACCAGAAAACCTTCACTTGTCTGAAAGACAGAACAGGAGT | 2152 |
| v.1 | 2201 | gttcggctgacctgggaagctggagctgaccacaacagcaatattagcga | 2250 |
| v.5 | 2153 | GTTCGGCTGACCTGGGAAGCTGGAGCTGACCACAACAGCAATATTAGCGA | 2202 |
| v.1 | 2251 | gtatattgttgaatttgaaggaaacaaagaagagcctggaaggtgggagg | 2300 |
| v.5 | 2203 | GTATATTGTTGAATTTGAAGGAAACAAAGAAGAGCCTGGAAGGTGGGAGG | 2252 |
| v.1 | 2301 | aactgaccagagtccaaggaaagaaaaccacagttatcttacctttggct | 2350 |
| v.5 | 2253 | AACTGACCAGAGTCCAAGGAAAGAAAACCACAGTTATCTTACCTTTGGCT | 2302 |
| v.1 | 2351 | ccatttgtgagataccagttcagggtcatagccgtgaacgaagtagggag | 2400 |
| v.5 | 2303 | CCATTTGTGAGATACCAGTTCAGGGTCATAGCCGTGAACGAAGTAGGGAG | 2352 |
| v.1 | 2401 | aagtcagcctagccagccgtcagaccatcatgaaacaccaccagcagctc | 2450 |
| v.5 | 2353 | AAGTCAGCCTAGCCAGCCGTCAGACCATCATGAAACACCACCAGCAGCTC | 2402 |
| v.1 | 2451 | cagataggaatccacaaaacataagggttcaagcctctcaacccaaggaa | 2500 |
| v.5 | 2403 | CAGATAGGAATCCACAAAACATAAGGGTTCAAGCCTCTCAACCCAAGGAA | 2452 |
| v.1 | 2501 | atgattataaagtgggagcctttgaaatccatggagcagaatggaccagg | 2550 |
| v.5 | 2453 | ATGATTATAAAGTGGGAGCCTTTGAAATCCATGGAGCAGAATGGACCAGG | 2502 |
| v.1 | 2551 | cctagagtacagagtgacctggaagccacagggagccccagtggagtggg | 2600 |
| v.5 | 2503 | CCTAGAGTACAGAGTGACCTGGAAGCCACAGGGAGCCCCAGTGGAGTGGG | 2552 |
| v.1 | 2601 | aagaagaaacagtcacaaaccacacattgcgggtgatgacgcctgctgtc | 2650 |
| v.5 | 2553 | AAGAAGAAACAGTCACAAACCACACATTGCGGGTGATGACGCCTGCTGTC | 2602 |
| v.1 | 2651 | tatgccccttatgatgtcaaggtccaggctatcaatcaactaggatctgg | 2700 |
| v.5 | 2603 | TATGCCCCTTATGATGTCAAGGTCCAGGCTATCAATCAACTAGGATCTGG | 2652 |
| v.1 | 2701 | gcctgaccctcagtcagtgactctctattctggagaagactatcctgata | 2750 |
| v.5 | 2653 | GCCTGACCCTCAGTCAGTGACTCTCTATTCTGGAGAAGACTATCCTGATA | 2702 |
| v.1 | 2751 | cagctccagtgatccatggggtggacgttataaacagtacattagttaaa | 2800 |
| v.5 | 2703 | CAGCTCCAGTGATCCATGGGGTGGACGTTATAAACAGTACATTAGTTAAA | 2752 |
| v.1 | 2801 | gttacctggtcaacagttccaaaggacagagtacatggacgtctgaaagg | 2850 |
| v.5 | 2753 | GTTACCTGGTCAACAGTTCCAAAGGACAGAGTACATGGACGTCTCAAAGG | 2802 |

TABLE LIIId-continued

Nucleotide sequence alignment of 282P1G03 v.1 (SEQ ID NO: 170) and 282P1G03 v.5 (SEQ ID NO: 171)

```
v.1  2851  ctatcagataaattggtggaaaacaaaaagtctgttggatggaagaacac  2900
v.5  2803  CTATCAGATAAATTGGTGCAAAACAAAAAGTCTGTTGGATGGAAGAACAC  2852

v.1  2901  atcccaaagaagtgaacattctaagattttcaggacaaagaaactctgga  2950
v.5  2853  ATCCCAAAGAAGTGAACATTCTAAGATTTTCAGGACAPAGAAACTCTGGA  2902

v.1  2951  atggttccttccttagatgcctttagtgaatttcatttaacagtcttagc  3000
v.5  2903  ATGGTTCCTTCCTTAGATGCCTTTAGTGAATTTCATTTAACAGTCTTAGC  2952

v.1  3001  ctataactctaaaggagctggtcctgaaagtgagccttatatatttcaaa  3050
v.5  2953  CTATAACTCTAAAGGAGCTGGTCCTGAAAGTGAGCCTTATATATTTCAAA  3002

v.1  3051  caccagaaggagtacctgaacagccaacttttctaaaggtcatcaaagtt  3100
v.5  3003  CACCAGAAGGAGTACCTGAACAGCCAACTTTTCTAAAGGTCATCAAAGTT  3052

v.1  3101  gataaagacactgccactttatcttggggactacctaagaaattaaatgg  3150
v.5  3053  GATAAAGACACTGCCACTTTATCTTGGGGACTACCTAAGAAATTAAATGG  3102

v.1  3151  aaacttaactggctatcttttgcaatatcagataataaatgacacctacg  3200
v.5  3103  AAACTTAACTGGCTATCTTTTGCAATATCAGATAATAAATGACACCTACG  3152

v.1  3201  agattggagaattaaatgatattaacattacaactccatcaaagcccagc  3250
v.5  3153  AGATTGGAGAATTAAATGATATTAACATTACAACTCCATCAAAGCCCAGC  3202

v.1  3251  tggcacctctcaaacctgaatgcaactaccaagtacaaattctacttgag  3300
v.5  3203  TGGCACCTCTCAAACCTGAATGCAACTACCAAGTACAAATTCTACTTGAG  3252

v.1  3301  ggcttgcacttcacagggctgtggaaaaccgatcacggaggaaagctcca  3350
v.5  3253  GGCTTGCACTTCACAGGGCTGTGGAAAAACCGATCACGGAGGAAAGTCCA  3302

v.1  3351  ccttaggagaagggagtaaaggtatcgggaagatatcaggagtaaatctt  3400
v.5  3303  CCTTAGGAGAAGGGAGTAAAGGTATCGGGAAGATATCAGGAGTAAATCTT  3352

v.1  3401  actcaaaagactcacccaatagaggtatttgagccgggagctgaacatat  3450
v.5  3353  ACTCAAAAGACTCACCCAATAGAGGTATTTGAGCCGGGAGCTGAACATAT  3402

v.1  3451  agttcgcctaatgactaagaattggggcgataacgatagcatttttcaag  3500
v.5  3403  AGTTCGCCTAATGACTAAGAATTGGGGCGATAAcGATAGCATTTTTCAAG  3452

v.1  3501  atgtaattgagacaagagggagagaatatgctggtttatatgatgacatc  3550
v.5  3453  ATGTAATTGAGACAAGAGGGAGAGAATATGCTGGTTTATATGATGACATC  3502

v.1  3551  tccactcaaggctggtttattggactgatgtgtgcgattgctcttctcac  3600
v.5  3503  TCCACTCAAGGCTGGTTTATTGGACTGATGTGTGCGATTGCTCTTCTCAC  3552

v.1  3601  actactattattaactgtttgctttgtgaagaggaatagaggtggaaagt  3650
v.5  3553  ACTACTATTATTAACTGTTTGCTTTGTGAAGAGGAATAGAGGTGGAAAGT  3602

v.1  3651  actcagttaaagaaaaggaagatttgcatccagacccagaaattcagtca  3700
v.5  3603  ACTCAGTTAAAGAAAAGGAAGATTTGCATCCAGACCCAGAAATTCAGTCA  3652

v.1  3701  gtaaaagatgaaacctttggtgaatacagtgacagtgatgaaaagcctct  3750
v.5  3653  GTAAAGATGAAACCTTTGGTGAATACAGTGACAGTGATGAAAAAGCCTCT  3702

v.1  3751  caaaggaagccttcggtcccttaatagggatatgcagcctactgaaagtg  3800
v.5  3703  CAAAGGAAGCCTTCGGTCCCTTAATAGGGATATGCAGCCTACTGAAAGTG  3752
```

TABLE LIIId-continued

Nucleotide sequence alignment of 282P1G03 v.1 (SEQ ID NO: 170) and 282P1G03 v.5 (SEQ ID NO: 171)

```
v.1  3801  ctgacagcttagtcgaatacggagagggagaccatggtctcttcagtgaa  3850
           ||||||||||||||||||||||||||||||||||||||||||||||||||
v.5  3753  CTGACAGCTTAGTCGAATACCGAGAGGGAGACCATGGTCTCTTCAGTGAA  3802

v.1  3851  gatggatcatttattggtgcctacgctggatctaaggagaagggatctgt  3900
           ||||||||||||||||||||||||||||||||||||||||||||||||||
v.5  3803  GATGGATCATTTATTGGTGCCTACGCTGGATCTAAGGAGAAGGGATCTGT  3852

v.1  3901  tgaaagcaatggaagttctacagcaacttttccccttcgggcataaacac  3950
           ||||||||||||||||||||||||||||||||||||||||||||||||||
v.5  3853  TGAAAGCAATGGAAGTTCTACAGCAACTTTTCCCCTTCGGGCATAAACAC  3902

v.1  3951  aacatatgtaagcaacgctactggttcaccccaaccttccatatttatct  4000
           ||||||||||||||||||||||||||||||||||||||||||||||||||
v.5  3903  AACATATGTAAGCAACGCTACTGGTTCACCCCAACCTTCCATATTTATCT  3952

v.1  4001  gttcaaaggagcaagaactttcatataggaatagaaacatgctggccgaa  4050
           ||||||||||||||||||||||||||||||||||||||||||||||||||
v.5  3953  GTTCAAAGGAGCAAGAACTTTCATATAGGAATAGAAACATGCTGGCCGAA  4002

v.1  4051  gatttcatccagaagtcaacatcctcgcattatgttgaaaagagtagtac  4100
           ||||||||||||||||||||||||||||||||||||||||||||||||||
v.5  4003  GATTTCATCCAGAAGTCAACATCCTGCAATTATGTTGAAAAGAGTAGTAC  4052

v.1  4101  tttcttcaaaatataaaatgccaagcacttcaggcctatgttttgcttat  4150
           ||||||||||||||||||||||||||||||||||||||||||||||||||
v.5  4053  TTTCTTCAAAATATAAAATGCCAAGCACTTCAGGCCTATGTTTTGCTTAT  4102

v.1  4151  attgttttcaggtgctcaaaatgcaaaacacaaaacaaatcctgcattta  4200
           ||||||||||||||||||||||||||||||||||||||||||||||||||
v.5  4103  ATTGTTTTCAGGTGCTCAAAATGCAAAACACAAAACAAATCCTGCATTTA  4152

v.1  4201  gatacacctcaactaaatccaaagtccccattcagtatattccatatttg  4250
           ||||||||||||||||||||||||||||||||||||||||||||||||||
v.5  4153  GATACACCTCAACTAAATCCAAAGTCCCCATTCAGTATATTCCATATTTG  4202

v.1  4251  cctgattttactattcggtgtgtttgcatagatgttgctacttggtgggt  4300
           ||||||||||||||||||||||||||||||||||||||||||||||||||
v.5  4203  CCTGATTTTACTATTCGGTGTGTTTGCATAGATGTTGCTACTTGGTGGGT  4252

v.1  4301  ttttctccgtatgcacattggtatacagtctctgagaactggcttggtga  4350
           ||||||||||||||||||||||||||||||||||||||||||||||||||
v.5  4253  TTTTCTCCGTATGCACATTGGTATACAGTCTCTGAGAACTGGCTTGGTGA  4302

v.1  4351  ctttgcttcactacaggttaaaagaccataagcaaactggttatttaaaa  4400
           ||||||||||||||||||||||||||||||||||||||||||||||||||
v.5  4303  CTTTGCTTCACTACAGGTTAAAAGACCATAAGCAAACTGGTTATTTAAAA  4352

v.1  4401  tgtaaaaaggaatatgaaagtcttattaaaacacttcattgaaaatatac  4450
           ||||||||||||||||||||||||||||||||||||||||||||||||||
v.5  4353  TGTAAAAAGGAATATGAAAGTCTTATTAAAACACTTCATTGAAAATATAC  4402

v.1  4451  agtctaaatttattatttaaattttactagcaaaagtcttaggtgaacaa  4500
           ||||||||||||||||||||||||||||||||||||||||||||||||||
v.5  4403  AGTCTAAATTTATTATTTAAATTTTACTAGCAAAAGTCTTAGGTGAACAA  4452

v.1  4501  tcaactagtatttgttgagctcctatttgcccagagatggtcatatttaa  4550
           ||||||||||||||||||||||||||||||||||||||||||||||||||
v.5  4453  TCAACTAGTATTTGTTGAGCTCCTATTTGCCCAGAGATGGTCATATTTAA  4502

v.1  4551  acagaagtatacgtttttcagtttcaacatgaatttttttatttctgtca  4600
           ||||||||||||||||||||||||||||||||||||||||||||||||||
v.5  4503  ACAGAAGTATACGTTTTTCAGTTTCAACATGAATTTTTTTATTTCTGTCA  4552

v.1  4601  gttatgacatccacgagcatcactttttgtgtctgttttttttttttct  4650
           ||||||||||||||||||||||||||||||||||||||||||||||||||
v.5  4553  GTTATGACATCCACgAGCATCACTTTTTGTGTCTGTTTTTTTTTTTTCT  4602

v.1  4651  tggactaaattcaactgcatggaagcggtggtcagaaggttgttttatac  4700
           ||||||||||||||||||||||||||||||||||||||||||||||||||
v.5  4603  TGGACTAAATTCAACTGCATGGAAGCGGTGGTCAGAAGGTTGTTTTATAC  4652

v.1  4701  gagaacaggcagaaagtgcccattgttcaggattctaatagctacatcta  4750
           ||||||||||||||||||||||||||||||||||||||||||||||||||
v.5  4653  GAGAACAGGCAGAAAGTGCCCATTGTTCAGGATTCTAATAGCTACATCTA  4702
```

TABLE LIIId-continued

Nucleotide sequence alignment of 282P1G03 v.1 (SEQ ID NO: 170) and 282P1G03 v.5 (SEQ ID NO: 171)

```
v.1  4751  cttaatatcttcatttctaaattgactgcttttaccttttcctcatgttt  4800
           ||||||||||||||||||||||||||||||||||||||||||||||||||
v.5  4703  CTTAATATCTTCATTTCTAAATTGACTGCTTTTACCTTTTCTCATGTTT  4752

v.1  4801  atataatggtatgcttgcatatatttcatgaatacattgtacatattatg  4850
           ||||||||||||||||||||||||||||||||||||||||||||||||||
v.5  4753  ATATAATGGTATGCTTGCATATATTTCATGAATACATTGTACATATTATG  4802

v.1  4851  ttaatatttacacaatttaaaatatagatgtgttttattttgaagtgaga  4900
           ||||||||||||||||||||||||||||||||||||||||||||||||||
v.5  4803  TTAATATTTACACAATTTAAAATATAGATGTGTTTTATTTTGAAGTGAGA  4852

v.1  4901  aaatgaacattaacaggcatgtttgtacagctagaatatattagtaagat  4950
           ||||||||||||||||||||||||||||||||||||||||||||||||||
v.5  4853  AAATGAACATTAACAGGCATGTTTGTACAGCTAGAATATATTAGTAAGAT  4902

v.1  4951  actgtttttcgtcattccagagctacaactaataacacgaggttccaaag  5000
           ||||||||||||||||||||||||||||||||||||||||||||||||||
v.5  4903  ACTGTTTTTCGTCATTCCAGAGCTACAACTAATAACACGAGGTTCCAAAG  4952

v.1  5001  ctgaagactttgtataaagtatttgggttttgttcttgtattgctttctt  5050
           ||||||||||||||||||||||||||||||||||||||||||||||||||
v.5  4953  CTGAAGACTTTGTATAAAGTATTTGGGTTTTGTTCTTGTATTGCTTTCTT  5002

v.1  5051  tcaacagtttcaaaataaaatatcatacaaatattgagggaaatgttttc  5100
           ||||||||||||||||||||||||||||||||||||||||||||||||||
v.5  5003  TCAACAGTTTCAAAATAAAATATCATAcAAATATTGAGGGAAATGTTTTC  5052

v.1  5101  atatttttcaaaataggtttttattgttgaatgtacatctaccccagccc  5150
           ||||||||||||||||||||||||||||||||||||||||||||||||||
v.5  5053  ATATTTTTCAAAATAGGTTTTTATTGTTGAATGTACATCTACCCCAGCCC  5102

v.1  5151  ctcaaaagaaaaactgtttacatagaaattcctacacatacgtttgcgta  5200
           ||||||||||||||||||||||||||||||||||||||||||||||||||
v.5  5103  CTCAAAAGAAAAACTCTTTACATAGAAATTCCTACACATACGTTTGCGTA  5152

v.1  5201  tatgttattttaaacatctttgtggtgagaatttttttccccgatattctc  5250
           ||||||||||||||||||||||||||||||||||||||||||||||||||
v.5  5153  TATGTTATTTTAAACATCTTTGTGGTGAGAATTTTTTCCCCGATATTCTC  5202

v.1  5251  cttctgtcaaagtcagaacaaattcagggaatttattttctggcagttgt  5300
           ||||||||||||||||||||||||||||||||||||||||||||||||||
v.5  5203  CTTCTGTCAAAGTCAGAACAAATTCAGGGAATTTATTTTCTGGCAGTTGT  5252

v.1  5301  gctccagtccttttaaaattgtacatgaacatgttttagaaacaatatgg  5350
           ||||||||||||||||||||||||||||||||||||||||||||||||||
v.5  5253  GCTCCAGTCCTTTTAAAATTGTACATGAACATGTTTTAGAAACAATATGG  5302

v.1  5351  aggatgatgcatacatgtcggtcaagttcagcgctcgacattttatggaa  5400
           ||||||||||||||||||||||||||||||||||||||||||||||||||
v.5  5303  AGGATGATGCATACATGTCGGTCAAGTTCAGCGCTCGACATTTTATGGAA  5352

v.1  5401  agatttttttaaccttaccacgaaatacttaactactgtttaagtgaatt  5450
           ||||||||||||||||||||||||||||||||||||||||||||||||||
v.5  5353  AGATTTTTTTAACCTTACCACGAAATACTTAACTACTGTTTAAGTGAATT  5402

v.1  5451  gacttatttcactttagtttttgaactgtgattattggtatactgttata  5500
           ||||||||||||||||||||||||||||||||||||||||||||||||||
v.5  5403  GACTTATTTCACTTTAGTTTTTGAACTGTGATTATTGGTATACTGTTATA  5452

v.1  5501  tcctcaacttggatttatggtaacccctttttagttcatggagaccaaaat  5550
           ||||||||||||||||||||||||||||||||||||||||||||||||||
v.5  5453  TCCTCAACTTGGATTTATGGTAACCCCTTtTAGTTCATGGAGACCAAAAT  5502

v.1  5551  ttggggtatttataatagtcagcgcaggaatgcacatggaatatctactt  5600
           ||||||||||||||||||||||||||||||||||||||||||||||||||
v.5  5503  TTGGGGTATTTATAATAGTCAGCGCAGGAATGCACATGGAATATCTACTT  5552

v.1  5601  gtccttttgaacctcacgagtcatccagaatgtatagacaggaaaagcat  5650
           ||||||||||||||||||||||||||||||||||||||||||||||||||
v.5  5553  GTCCTTTTGAACCTCACGAGTCATCCAGAATGTATAGACAGGAAAAGCAT  5602

v.1  5651  gtcttatttaaaactgtaatttatgggctcaggatctgaccgcagtcccg  5700
           ||||||||||||||||||||||||||||||||||||||||||||||||||
v.5  5603  GTCTTATTTAAAACTGTAATTTATGGGCTCAGGATCTGACCGCAGTCCCG  5652
```

TABLE LIIId-continued

Nucleotide sequence alignment of 282P1G03 v.1 (SEQ ID NO: 170) and 282P1G03 v.5 (SEQ ID NO: 171)

```
v.1  5701  ggagtaagcatttcaaaggggggaaggcagtgtggtccctaccctgtgtga  5750
           ||||||||||||||||||||||||||||||||||||||||||||||||||
v.5  5653  GGAGTAAGCATTTCAAAGGGGGAAGGCAGTGTGGTCCCTACCCTGTGTGA  5702

v.1  5751  atgtgaggatgtagacatccatcagtgcaactcgagctccatcctcctcc  5800
           ||||||||||||||||||||||||||||||||||||||||||||||||||
v.5  5703  ATGTGAGGATGTAGACATCCATCAGTGCAACTCGAGCTCCATCCTCCTCC  5752

v.1  5801  gatttctaaggctccagttttctggagggacagtcatcatgttttgattt  5850
           ||||||||||||||||||||||||||||||||||||||||||||||||||
v.5  5753  GATTTCTAAGGCTCCAGTTTTCTGGAGGGACAGTCATCATGTTTTGATTT  5802

v.1  5851  atctgggagaaaactgtggtgcacagcttgtgaggagggcaaggttgtga  5900
           ||||||||||||||||||||||||||||||||||||||||||||||||||
v.5  5803  ATCTGGGAGAAAACTGTGGTGCACAGCTTGTGAGGAGGGCAAGGTTGTGA  5852

v.1  5901  cgttcgagcttagttctggtgttattctgtctcctcttctttgtcatcag  5950
           ||||||||||||||||||||||||||||||||||||||||||||||||||
v.5  5853  CGTTCGAGCTTAGTTCTGGTGTTATTCTGTCTCCTCTTCTTTGTCATCAG  5902

v.1  5951  ccaaaacgtggtttttaaagagagtcatgcaggttagaaataatgtcaaa  6000
           ||||||||||||||||||||||||||||||||||||||||||||||||||
v.5  5903  CCAAAACGTGGTTTTTAAAGAGAGTCATGCAGGTTAGAAATAATGTCAAA  5952

v.1  6001  aatatttaggaatttaataacctttaagtcagaaactaaaacaaatactg  6050
           ||||||||||||||||||||||||||||||||||||||||||||||||||
v.5  5953  AATATTTAGGAATTTAATAACCTTTAAGTCAGAAACTAAAACAAATACTG  6002

v.1  6051  aaatattagctcttcctacacttcgtgttcccctttagctgcctgaaaat  6100
           ||||||||||||||||||||||||||||||||||||||||||||||||||
v.5  6003  AAATATTAGCTCTTCCTACACTTCGTGTTCCCCTTTAGCTGCCTGAAAAT  6052

v.1  6101  caagattgctcctactcagatcttctgagtggctaaaacttatggatatg  6150
           ||||||||||||||||||||||||||||||||||||||||||||||||||
v.5  6053  CAAGATTGCTCCTaCTCAGATCTTCTGAGTGGCTAAAACTTATGGATATG  6102

v.1  6151  aaaaatgagattgaatgatgactatgctttgctatcattgttacctttcc  6200
           ||||||||||||||||||||||||||||||||||||||||||||||||||
v.5  6103  AAAAATGAGATTGAATGATGACTATGCTTTGCTATCATTGTTACCTTTCC  6152

v.1  6201  tcaatactatttggcaactactgggactcttcagcacaaaaggaatagat  6250
           ||||||||||||||||||||||||||||||||||||||||||||||||||
v.5  6153  TCAATACTATTTGOCAACTACTGGGACTCTTCAGCACAAAAGGAATAGAT  6202

v.1  6251  ctatgattgaccctgattttaattgtgaaattatatgattcatatatttt  6300
           ||||||||||||||||||||||||||||||||||||||||||||||||||
v.5  6203  CTATGATTGACCCTGATTTTAATTGTGAAATTATATGATTCATATATTTT  6252

v.1  6301  atgaatcagaataaccttcaaataaaataaatctaagtcggttaaaatgg  6350
           ||||||||||||||||||||||||||||||||||||||||||||||||||
v.5  6253  ATGAATCAGAATAACCTTCAAATAAAATAAATCTAAGTCGGTTAAAATGG  6302

v.1  6351  atttcatgattttccctcagaaaatgagtaacggagtccacggcgtgcaa  6400
           ||||||||||||||||||||||||||||||||||||||||||||||||||
v.5  6303  ATTTCATGATTTTCCCTCAGAAAATGAGTAACgGAGTCCACGGCGTGCAA  6352

v.1  6401  tggtaattataaattggtgatgcttgtttgcaaattgcccactcgtgata  6450
           ||||||||||||||||||||||||||||||||||||||||||||||||||
v.5  6353  TGGTAATTATAAATTGGTGATGCTTGTTTGCAAATTGCCCACTCGTGATA  6402

v.1  6451  agtcaacagccaatatttaaaactttgttcgttactggctttaccctaac  6500
           ||||||||||||||||||||||||||||||||||||||||||||||||||
v.5  6403  AGTCAACAGCCAATATTTAAAACTTTGTTCGTTACTGGCTTTACCCTAAC  6452

v.1  6501  tttctctagtctactgtcaatatcattttaatgtaattgattgtatatag  6550
           ||||||||||||||||||||||||||||||||||||||||||||||||||
v.5  6453  TTTCTCTAGTCTACTGTCAATATCATTTTAATGTAATTGATTGTATATAG  6502

v.1  6551  tctcaagaatggttggtgggcatgagttcctagagaactgtccaagggtt  6600
           ||||||||||||||||||||||||||||||||||||||||||||||||||
v.5  6503  TCTCAAGAATGGTTGGTGGGCATGAGTTCCTAGAGAACTGTCCAAGGGTT  6552

v.1  6601  gggaaaatccaaattctcttcctggctccagcactgattttgtacataaa  6650
           ||||||||||||||||||||||||||||||||||||||||||||||||||
v.5  6553  GGGAAAATCCAAATTCTCTTCCTGGCTCCAGCACTGATTTTGTACATAAA  6602
```

TABLE LIIId-continued

Nucleotide sequence alignment of 282P1G03 v.1 (SEQ ID NO: 170) and 282P1G03 v.5 (SEQ ID NO: 171)

```
v.1  6651  cattaggcaggttgcttaaccttttttatttcaaactctctcaactctaaa  6700
           ||||||||||||||||||||||||||||||||||||||||||||||||||
v.5  6603  CATTAGGCAGGTTGCTTAACCTTTTTATTTCAAACTCTCTCAACTCTAAA  6652

v.1  6701  gtgctaataataatcccagttaccttatctttgtcacagggtgttctttt  6750
           ||||||||||||||||||||||||||||||||||||||||||||||||||
v.5  6653  GTGCTAATAATAATCTCAGTTACCTTATCTTTGTCACAGGGTGTTCTTTT  6702

v.1  6751  ttatgaagaaaaatttgaaaatgataaaagctaagatgccttctaacttc  6800
           ||||||||||||||||||||||||||||||||||||||||||||||||||
v.5  6703  TTATGAAGAAAAATTTGAAAATGATAAAAGCTAAGATGCCTTCTAACTTC  6752

v.1  6801  ataagcaaacctttaactaattatgtatctgaaagtcacccccacatacc  6850
           ||||||||||||||||||||||||||||||||||||||||||||||||||
v.5  6753  ATAAGCAAACCTTTAACTAATTATGTATCTGAAAGTCACCCCCACATACC  6802

v.1  6851  aactcaactttttttcctgtgaacacataaatatatttttatagaaaaaca  6900
           ||||||||||||||||||||||||||||||||||||||||||||||||||
v.5  6803  AACTCAACTTTTTTCCTGTGAACACATAAATATATTTTTATAGAAAAACA  6852

v.1  6901  aatctacataaaataaatctactgtttagtgagcagtatgacttgtacat  6950
           ||||||||||||||||||||||||||||||||||||||||||||||||||
v.5  6853  AATCTACATAAAATAAATCTACTGTTTAGTGAGCAGTATGACTTGTACAT  6902

v.1  6951  gccattgaaaattattaatcagaagaaaattaagcagggtctttgctata  7000
           ||||||||||||||||||||||||||||||||||||||||||||||||||
v.5  6903  GCCATTGAAAATTATTAATCAGAAGAAAATTAAGCAGGGTCTTTGCTATA  6952

v.1  7001  caaaagtgttttccactaattttgcatgcgtatttataagaaaaatgtga  7050
           ||||||||||||||||||||||||||||||||||||||||||||||||||
v.5  6953  CAAAAGTGTTTTCCACTAATTTTGCATGCGTATTTATAAGAAAAATGTGA  7002

v.1  7051  atttggtggttttattctatcggtataaaggcatcgatattttagatgca  7100
           ||||||||||||||||||||||||||||||||||||||||||||||||||
v.5  7003  ATTTGGTGGTTTTATTCTATCGGTATAAAGGCATCGATATTTTAGATGCA  7052

v.1  7101  cccgtgtttgtaaaaatgtagagcacaatggaattatgctggaagtctca  7150
           ||||||||||||||||||||||||||||||||||||||||||||||||||
v.5  7053  CCCGTGTTTGTAAAAATGTAGAGCACAATGGAATTATGCTGGAAGTCTCA  7102

v.1  7151  aataatatttttttcctattttatactcatggaagagataagctaaagag  7200
           ||||||||||||||||||||||||||||||||||||||||||||||||||
v.5  7103  AATAATATTTTTTTCCTATTTTATACTCATGGAAGAGATAAGCTAAAGAG  7152

v.1  7201  gggacaataatgagaaatgttggtgtgcttttctaagcatttaaaacata  7250
           ||||||||||||||||||||||||||||||||||||||||||||||||||
v.5  7153  GGGACAATAATGAGAAATGTTGGTGTGCTTTTCTAAGCATTTAAAACATA  7202

v.1  7251  attgccaattgaaaccctaaatatgtttacataccattaagatatgattc  7300
           ||||||||||||||||||||||||||||||||||||||||||||||||||
v.5  7203  ATTGCCAATTGAAACCCTAAATATGTTTACATACCATTAAGATATGATTC  7252

v.1  7301  atgtaacaatgttaaattaattataatgggattgggtttgttatctgtgg  7350
           ||||||||||||||||||||||||||||||||||||||||||||||||||
v.5  7253  ATGTAACAATGTTAAATTAATTATAATGGGATTGGGTTTGTTATCTGTGG  7302

v.1  7351  tagtatatatcctagtgttcctatagtgaaataagtagggttcagccaaa  7400
           ||||||||||||||||||||||||||||||||||||||||||||||||||
v.5  7303  TAGTATATATCCTAGTGTTCCTATAGTGAAATAAGTAGGGTTCAGCCAAA  7352

v.1  7401  gctttctttgttttgtaccttaaattgttcgattacgtcatcaaaagaga  7450
           ||||||||||||||||||||||||||||||||||||||||||||||||||
v.5  7353  GCTTTCTTTGTTTTGTACCTTAAATTGTTCGATTACGTCATCAAAAGAGA  7402

v.1  7451  tgaaaggtatgtagaacaggttcacgtgattacctttttcttttggcttg  7500
           ||||||||||||||||||||||||||||||||||||||||||||||||||
v.5  7403  TGAAAGGTATGTAGAACAGGTTCACGTGATTACCTTTTTCTTTTGGCTTG  7452

v.1  7501  gattaatattcatagtagaactttataaaacgtgtttgtattgtaggtgg  7550
           ||||||||||||||||||||||||||||||||||||||||||||||||||
v.5  7453  GATTAATATTCATAGTAGAACTTTATAAAACGTGTTTGTATTGTAGGTGG  7502

v.1  7551  tgtttgtattatgcttatgactatgtatggtttgaaaatattttcattat  7600
           ||||||||||||||||||||||||||||||||||||||||||||||||||
v.5  7503  TGTTTGTATTATGCTTATGACTATGTATGGTTTGPAPATATTTTCATTAT  7552
```

TABLE LIIId-continued

Nucleotide sequence alignment of 282P1G03 v.1 (SEQ ID NO: 170) and 282P1G03 v.5 (SEQ ID NO: 171)

| | | | |
|---|---|---|---|
| v.1 | 7601 | acatgaaattcaactttccaaataaaagttctacttcatgtaatccaaaa | 7650 |
| v.5 | 7553 | ACATGAAATTCAACTTTCCAAATAAAAGTTCTACTTCATGTAATCCAAAA | 7602 |

TABLE LIVd

Peptide sequences of protein coded by 282P1G03 v.5

(SEQ ID NO:172)

```
MEPLLLGRGL IVYLMFLLLK FSKATEIPSS VQQVPTIIKQ SKVQVAFPFD EYFQIECEAK  60
GNPEPTFSWT KDGNPFYFTD HRIIPSNNSG TFRIPNEGHI SHFQGKYRCF ASNKLGIANS  120
EEIEFIVPSV PKLPKEKIDP LEVEEGDPIV LPCIPPKGLP PLHIYWMNIE LEHIEQDERV  180
YMSQKGDLYF ANVEEKDSRN DYCCFAAFPR LRTIVQKMPM KLTVNSSNSI KQRKPKILLP  240
PTESGSESSI TILKGEILLL ECFAEGLPTP QVDWNKIGGD LPKGRETKEN YGKTLKIENV  300
SYQDKGNYRC TASNFLGTAT HDFHVIVEEP PRWTKKPQSA VYSTGSNGIL LCEAEGEPQP  360
TIKWRVNGSP VDNHPFAGDV VEPREISETH LQPNRTAVYQ CEASNVHGTI LANANIDVVD  420
VRPLIQTKDG ENYATVVGYS AFLHCEFFAS PEAVVSWQKV EEVKPLEGRR YHIYENGTLQ  480
INRTTEEDAG SYSCWVENAI GKTAVTANLD IRNATKLRVS PKNPRIPKLH MLELHCESKC  540
DSHLKHSLKL SWSKDGEAFE INGTEDGRII IDGANLTISN VTLEDQGIYC CSAHTALDSA  600
ADITQVTVLD VPDPPENLHL SERQNRSVRL TWEAGADHNS NISEYIVEFE GNKEEPGRWE  660
ELTRVQGKKT TVILPLAPFV RYQFRVIAVN EVGRSQPSQP SDHHETPPAA PDRNPQNIRV  720
QASQPKEMII KWEPLKSMEQ NQPGLEYRVT WKPQGAPVEW EEETVTNHTL RVMTPAVYAP  780
YDVKVQAINQ LGSGPDPQSV TLYSGEDYPD TAPVIHGVDV INSTLVKVTW STVPKDRVHG  840
RLKGYQINWW KTKSLLDGRT HPKEVNILRF SGQRNSGMVP SLDAFSEFHL TVLAYNSKGA  900
GPESEPYIFQ TPEGVPEQPT FLKVIKVDKD TATLSWGLPK KINGNLTGYL LQYQIINDTY  960
EIGELNDINI TTPSKPSWHL SNLNATTKYK FYLRACTSQG CGKPITEESS TLGEGSKGIG  1020
KISGVNLTQK THPIEVFEPG AEHIVRLMTK NWGDNDSIFQ DVIETRGREY AGLYDDISTQ  1080
GWFIGLMCAI ALLTLLLLTV CFVKRNRGGK YSVKEKEDLH PDPEIQSVKD ETFGEYSDSD  1140
EKPLKGSLRS LNRDMQPTES ADSLVEYGEG DHGLFSEDGS FIGAYAGSKE KGSVESNGSS  1200
TATFPLRA  1208
```

TABLE LVd

Amino acid sequence alignment of 282P1G03 v.1 (SEQ ID NO: 173) and 282P1G03 v.5 (SEQ ID NO: 174)

| | | | |
|---|---|---|---|
| v.1 | 1 | MEPLLLGRGLIVYLMFLLLKFSKAIETPSSVQQVPTIIKQSKVQVAFPFD | 50 |
| v.5 | 1 | MEPLLLCRGLIVYLMFLLLKFSKAIEIPSSVQQVPTIIKQSKVQVAFPFD | 50 |
| v.1 | 51 | EYFQIECEAKGNPEPTFSWTKDGNPFYFTDHRIIPSNNSGTFRIPNEGHI | 100 |
| v.5 | 51 | EYFQIECEAKGHPEPTFSWTKDGNPFYFTDHRIIPSNNSGTFRIPNEGHI | 100 |
| v.1 | 101 | SHFQGKYRCFASNKLGIAMSEEIEFIVPSVPKLPKEKIDPLEVEEGDPIV | 150 |
| v.5 | 101 | SHFQGKYRCFASNKLGIAMSEEIEFIVPSVPKLPKEKIDPLEVEEGDPIV | 150 |
| v.1 | 151 | LPCNPPKGLPPLHIYWMNIELEHIEQDERVYMSQKGDLYFANVEEKDSRN | 200 |
| v.5 | 151 | LPCNPPKGLPPLHIYWMNIELEHIEQDERVYMSQKGDLYFANVEEKDSRN | 200 |

TABLE LVd-continued

Amino acid sequence alignment of 282P1G03 v.1 (SEQ ID NO: 173) and 282P1G03 v.5 (SEQ ID NO: 174)

```
v.1   201  DYCCFAAFPRLRTIVQKMPMKLTVNSLKHANDSSSSTEIGSKANSIKQRK  250
           |||||||||||||||||||||||||||||                :|||||
v.5   201  DYCCFAAFPRLRTIVQKMPMKLTVNS-----------------SNSIKQRK  234

v.1   251  PKLLLPPTESGSESSTTILKGEILLLECFAEGLPTPQVDWNKIGGDLPKG   300
           ||||||||||||||||:|||||||||||||||||||||||||||||||||
v.5   235  PKLLLPPTESGSESSITILKGEILLLECFAEGLPTPQVDWNKIGGDLPKG   284

v.1   301  RETKENYGKTLKIENVSYQDKGNYRCTASNFLGTATHDFHVIVEEPPRWT   350
           ||||||||||||||||||||||||||||||||||||||||||||||||||
v.5   285  RETKENYGKTLKIENVSYQDKGNYRCTASNFLGTATHDFHVIVEEPPRWT   334

v.1   351  KKPQSAVYSTGSNGILLCEAEGEPQPTIKWRVNGSPVDNHPFAGDVVFPR   400
           ||||||||||||||||||||||||||||||||||||||||||||||||||
v.5   335  KKPQSAVYSTGSNGILLCEAEGEPQPTIKWRVNGSPVDNHPFAGDVVFPR   384

v.1   401  EISFTNLQPNHTAVYQCEASNVHGTILANANIDVVDVRPLIQTKDGENYA   450
           ||||||||||||||||||||||||||||||||||||:|||||||:|||||
v.5   385  EISFTNLQPNHTAVYQCEASNVHGTILANANIDVVTDRPLIQTKLGENYA   434

v.1   451  TVVGYSAFLHCEFFASPEAVVSWQKVEEVKPLEGRRYHIYENGTLQINRT  500
           ||||||||||||||||||||||||||||||||||||||||||||||||||
v.5   435  TVVGYSAFLHCEFFASPEAVVSWQKVEEVKPLEGRRYHIYENGTLQINRT  484

v.1   501  TEEDAGSYSCWVENAIGKTAVTANLDIRNATKLRVSPKNPRIPKLHMLEL  550
           ||||||||||||||||||||||||:|||||||||||||||||||||||||
v.5   485  TEEDAGSYSCWVENAIGKTAVTANIDIRNATKLRVSPKNPRIPKLHMLEL  534

v.1   551  HCESKCDSHLKHSLKLSWSKDGEAFEINGTEDGRIIIDGANLTISNVTLE  600
           ||||||||||||||||||||||||||||||||||||||||||||||||||
v.5   535  HCESKCDSHLKHSLKLSWSKDGEAFEINGTEDGRIIIDGANLTISNVTLE  584

v.1   601  DQGIYCCSAHTALDSAADITQVTVLDVPDPPENLHLSERQNRSVRLTWEA  650
           ||||||||||||||||||||||||||||||||||||||||||||||||||
v.5   585  DQGIYCCSAHTALDSAADITQVTVLDVPDPPENLHLSERQNRSVRLTWEA  634

v.1   651  GADHNSNISEYIVEFEGNKEEPGRWEELTRVQGKKTTVILPLAPFVRYQF  700
           ||||||||||||||||||||||||||||||||||||||||||||||||||
v.5   635  GADHNSNISEYIVEFEGNKEEPGRWEELTRVQGKKTTVILPLAPFVRYQF  684

v.1   701  RVIAVNEVGRSQPSQPSDHHETPPAAPDRNPQNIRVQASQPKEMIIKWEP  750
           |||||||||||||||||||||||||:||||||||||||||||||||||||
v.5   685  RVIAVNEVGRSQPSQPSDHHETPPPAPDRNPQNIRVQASQPKEMIIKWEP  734

v.1   751  LKSMEQNGPGLEYRVTWKPQGAPVEWEEETVTNHTLRVMTPAVYAPYDVK  800
           ||||||||||||||||||||:|||||||||||||||||||||||||||||
v.5   735  LKSMEQNGPGLEYRVTWKPQCAPVEWEEETVTNHTLRVMTPAVYAPYDVK  784

v.1   801  VQAINQLGSGPDPQSVTLYSGEDYPDTAPVIHGVDVINSTLVKVTWSTVP  850
           ||||||||||||||||||||||||||||||||||||||||||||||||||
v.5   785  VQAINQLGSGPDPQSVTLYSGEDYPDTAPVIHGVDVINSTLVKVTWSTVP  834

v.1   851  KDRVHGRLKGYQINWWKTKSLLDGRTHPKEVNILRFSGQRNSGMVPSLDA  900
           ||||||||||||||||||||||||||||||||||||||:|||||||||||
v.5   835  KDRVHGRLKGYQINWWKTKSLLDGRTHPKEVNILRFSGQPNSGMVPSLDA  884

v.1   901  FSEFHLTVLAYNSKGAGPESEPYIFQTPEGVPEQPTFLKVIKVDKDTATL  950
           ||||||||||||||||||||||||||||||||||||||||||||||||||
v.5   885  FSEFHLTVLAYNSKGAGPESEPYIFQTPEGVPEQPTFLKVIKVDKDTATL  934

v.1   951  SWGLPKKLNGNLTGYLLQYQIINDTYEIGELNDINITTPSKPSWHLSNLN  1000
           ||||||||||||||||||||||||||||||||||||||||||||||||||
v.5   935  SWGLPKKLNGNLTGYLLQYQIINDTYEIGELNDINITTPSKPSWHLSNLN  984

v.1  1001  ATTKYKFYLRACTSQGCGKPITEESSTLGEGSKGIGKISGVNLTQKTHPI  1050
           ||||||||||||||||||||||||||||||||||||||||||||||||||
v.5   985  ATTKYKFYLRACTSQGCGKPITEESSTLGEGSKGIGKISGVNLTQKTHPI  1034

v.1  1051  EVFEPGAEHIVRLMTKNWGDNDSIFQDVIETRGREYAGLYDDISTQGWFI  1100
           ||||||||||||||||||||||||||||||||||||||||||||||||||
v.5  1035  EVFEPGAEHIVRLMTKNWGDNDSIFQDVIETRGREYAGLYDDISTQGWFI  1084

v.1  1101  GLMCAIALLTLLLLTVCFVKRNRGGKYSVKEKEDLHPDPEIQSVKDETFG  1150
           ||||||||||||||||||||||||||||||||||||||||||||||||||
v.5  1085  GLMCAIALLTLLLLTVCFVKRNRGGKYSVKEKEDLHPDPEIQSVKDETFG  1134
```

TABLE LVd-continued

Amino acid sequence alignment of 282P1G03 v.1 (SEQ ID NO: 173) and 282P1G03 v.5 (SEQ ID NO: 174)

```
v.1  1151  EYSDSDEKPLKGSLRSLNRDMQPTESADSLVEYGEGDHGLFSEDGSFIGA  1200
           ||||||||||||||||||||||||||||||||||||||||||||||||||
v.5  1135  EYSDSDEKPLKGSLRSLNRDMQPTESADSLVEYGEGDHGLFSEDGSFIGA  1184

v.1  1201  YAGSKEKGSVESNGSSTATFPLRA 1224
           ||||||||||||||||||||||||
v.5  1185  YAGSKEKGSVESNGSSTATFPLRA 1208
```

TABLE LIIe

Nucleotide sequence of transcript variant 282P1G03 v.6

(SEQ ID NO:175)

```
cggaccctgc gcgcccccgt cccggctccc ggccggctcg ggggagaagg cgcccgaggg  60
gaggcgccgg acagatcgcg tttcggaggc ggcgcaggtg ctgtaaactg caaaccataa  120
tcctgtctta atactgcaaa caaatcatag tggaactaag gggaacttaa tttactgttt  180
ccaggttaac taaggtctca gctgtaaacc aaaagtgaga ggagacatta agattttcat  240
tcttaccggg ttgtcttctt cctgaagagc aatggagccg cttttacttg gaagaggact  300
aatcgtatat ctaatgttcc tcctgttaaa attctcaaaa gcaattgaaa taccatcttc  360
agttcaacag gttccaacaa tcataaaaca gtcaaaagtc caagttgcct ttcccttcga  420
tgagtatttt caaattgaat gtgaagctaa aggaaatcca gaaccaacat tttcgtggac  480
taaggatggc aacccttttt atttcactga ccatcggata attecatoga acaattcagg  540
aacattcagg atcccaaacg aggggcacat atctcacttt caagggaaat accgctgctt  600
tgcttcaaat aaactgggaa tcgctatgtc agaagaaata gaatttatag ttccaaaatt  660
agaacacatc gaacaagatg aaagagtata catgagccaa aagggagatc tatacttcgc  720
aaacgtggaa gaaaaggaca gtcgcaatga ctactgttgc tttgctgcat ttccaagatt  780
aaggactatt gtacagaaaa tgccaatgaa actaacagtt aacagtttaa agcatgctaa  840
tgactcaagt tcatccacag aaattggttc caaggcaaat tccatcaagc aaagaaaacc  900
caaactgctg ttgcctccca ctgagagtgg cagtgagtct tcaattacca tcctcaaagg  960
ggaaatcttg ctgcttgagt gttttgctga aggcttgcca actccacagg ttgattggaa  1020
caaaattggt ggtgacttac caaaggggag agaaacaaaa gaaaattatg gcaagacttt  1080
gaagatagag aatgtctcct accaggacaa aggaaattat cgctgcacag ccagcaattt  1140
cttgggaaca gccactcacg attttcacgt tatagtagaa gagcctcctc gctggacaaa  1200
gaagcctcag agtgctgtgt atagcaccgg aagcaatggc atcttgttat gtgaggctga  1260
aggagaacct caacccacaa tcaagtggag agtcaatggc tccccagttg acaatcatcc  1320
atttgctggt gatgttgtct tccccaggga aatcagtttt accaaccttc aaccaaatca  1380
tactgctgtg taccagtgtg aagcctcaaa tgtccatgga actatccttg ccaatgccaa  1440
tattgatgtt gtggatgtcc gtccattgat acaaaccaaa gatggagaaa attacgctac  1500
agtggttggg tacagtgctt tcttacattg cgagttcttt gcttcacctg aggcagtcgt  1560
gtcctggcag aaggtggaag aagtgaaacc cctggagggc aggcggtatc atatctatga  1620
aaatggcaca ttgcagatca acagaaccac cgaagaagat gctgggtctt actcatgttg  1680
ggtagaaaat gctataggaa aaactgcagt cacagccaat ttggatatta gaaatgctac  1740
aaaacttaga gtttctccta agaatcctcg tatccccaaa ttgcatatgc ttgaattaca  1800
```

TABLE LIIe-continued

| Nucleotide sequence of transcript variant 282P1G03 v.6 |
| --- |
| ttgtgaaagc aaatgtgact cacatttgaa acacagtttg aagttgtcct ggagtaaaga 1860 |
| tggagaagcc tttgaaatta atggcacaga agatggcagg ataattattg atggagctaa 1920 |
| tttgaccata tctaatgtaa ctttagagga ccaaggtatt tactgctgtt cagctcatac 1980 |
| tgctctagac agtgctgccg atataactca agtaactgtt cttgatgttc cggatccacc 2040 |
| agaaaacctt cacttgtctg aaagacagaa caggagtgtt cggctgacct gggaagctgg 2100 |
| agctgaccac aacagcaata ttagcgagta tattgttgaa tttgaaggaa acaaagaaga 2160 |
| gcctggaagg tgggaggaac tgaccagagt ccaaggaaag aaaaccacag ttatcttacc 2220 |
| tttggctcca tttgtgagat accagttcag ggtcatagcc gtgaacgaag tagggagaag 2280 |
| tcagcctagc cagccgtcag accatcatga aacaccacca gcagctccag ataggaatcc 2340 |
| acaaaacata agggttcaag cctctcaacc caaggaaatg attataaagt gggagccttt 2400 |
| gaaatccatg gagcagaatg gaccaggcct agagtacaga gtgacctgga agccacaggg 2460 |
| agccccagtg gagtgggaag aagaaacagt cacaaaccac acattgcggg tgatgacgcc 2520 |
| tgctgtctat gccccttatg atgtcaaggt ccaggctatc aatcaactag gatctgggcc 2580 |
| tgaccctcag tcagtgactc tctattctgg agaagactat cctgatacag ctccagtgat 2640 |
| ccatggggtg gacgttataa acagtacatt agttaaagtt acctggtcaa cagttccaaa 2700 |
| ggacagagta catggacgtc tgaaaggcta tcagataaat tggtggaaaa caaaaagtct 2760 |
| gttggatgga agaacacatc ccaaagaagt gaacattcta agattttcag gacaaagaaa 2820 |
| ctctggaatg gttccttcct tagatgcctt tagtgaattt catttaacag tcttagccta 2880 |
| taactctaaa ggagctggtc ctgaaagtga gccttatata tttcaaacac cagaaggagt 2940 |
| acctgaacag ccaacttttc taaaggtcat caaagttgat aaagacactg ccactttatc 3000 |
| ttggggacta cctaagaaat taaatggaaa cttaactggc tatcttttgc aatatcagat 3060 |
| aataaatgac acctacgaga ttggagaatt aaatgatatt aacattacaa ctccatcaaa 3120 |
| gcccagctgg cacctctcaa acctgaatgc aactaccaag tacaaattct acttgagggc 3180 |
| ttgcacttca cagggctgtg gaaaaccgat cacggaggaa agctccacct taggagaagg 3240 |
| gagtaaaggt atcgggaaga tatcaggagt aaatcttact caaaagactc acccaataga 3300 |
| ggtatttgag ccgggagctg aacatatagt tcgcctaatg actaagaatt ggggcgataa 3360 |
| cgatagcatt tttcaagatg taattgagac aagagggaga gaatatgctg gtttatatga 3420 |
| tgacatctcc actcaaggct ggtttattgg actgatgtgt gcgattgctc ttctcacact 3480 |
| actattatta actgtttgct ttgtgaagag gaatagaggt ggaaagtact cagttaaaga 3540 |
| aaaggaagat ttgcatccag acccagaaat tcagtcagta aaagatgaaa cctttggtga 3600 |
| atacagtgac agtgatgaaa agcctctcaa aggaagcctt cggtccctta atagggatat 3660 |
| gcagcctact gaaagtgctg acagcttagt cgaatacgga gagggagacc atggtctctt 3720 |
| cagtgaagat ggatcattta ttggtgccta cgctggatct aaggagaagg gatctgttga 3780 |
| aagcaatgga agttctacag caacttttcc ccttcgggca taaacacaac atatgtaagc 3840 |
| aacgctactg gttcacccca accttccata tttatctgtt caaaggagca agaactttca 3900 |
| tataggaata gaaacatgct ggccgaagat ttcatccaga agtcaacatc ctgcaattat 3960 |
| gttgaaaaga gtagtacttt cttcaaaata taaaatgcca agcacttcag gcctatgttt 4020 |
| tgcttatatt gttttcaggt gctcaaaatg caaaacacaa aacaaatcct gcatttagat 4080 |

TABLE LIIe-continued

| Nucleotide sequence of transcript variant 282P1G03 v.6 |
|---|
| acacctcaac taaatccaaa gtccccattc agtatattcc atatttgcct gattttacta 4140 |
| ttcggtgtgt ttgcatagat gttgctactt ggtgggtttt tctccgtatg cacattggta 4200 |
| tacagtctct gagaactggc ttggtgactt tgcttcacta caggttaaaa gaccataagc 4260 |
| aaactggtta tttaaaatgt aaaaaggaat atgaaagtct tattaaaaca cttcattgaa 4320 |
| aatatacagt ctaaatttat tatttaaatt ttactagcaa aagtcttagg tgaacaatca 4380 |
| actagtattt gttgagctcc tatttgccca gagatggtca tatttaaaca gaagtatacg 4440 |
| tttttcagtt tcaacatgaa tttttttatt tctgtcagtt atgacatcca cgagcatcac 4500 |
| tttttgtgtc tgtttttttt tttttcttgg actaaattca actgcatgga agcggtggtc 4560 |
| agaaggttgt tttatacgag aacaggcaga aagtgcccat tgttcaggat tctaatagct 4620 |
| acatctactt aatatcttca tttctaaatt gactgctttt accttttttct catgtttata 4680 |
| taatggtatg cttgcatata tttcatgaat acattgtaca tattatgtta atatttacac 4740 |
| aatttaaaat atagatgtgt tttattttga agtgagaaaa tgaacattaa caggcatgtt 4800 |
| tgtacagcta gaatatatta gtaagatact gtttttcgtc attccagagc tacaactaat 4860 |
| aacacgaggt tccaaagctg aagactttgt ataaagtatt tgggttttgt tcttgtattg 4920 |
| ctttctttca acagtttcaa aataaaatat catacaaata ttgagggaaa tgttttcata 4980 |
| tttttcaaaa taggttttta ttgttgaatg tacatctacc ccagcccctc aaaagaaaaa 5040 |
| ctgtttacat agaaattcct acacatacgt ttgcgtatat gttattttaa acatctttgt 5100 |
| ggtgagaatt ttttccccga tattctcctt ctgtcaaagt cagaacaaat tcagggaatt 5160 |
| tattttctgg cagttgtgct ccagtccttt taaaattgta catgaacatg ttttagaaac 5220 |
| aatatggagg atgatgcata catgtcggtc aagttcagcg ctcgacattt tatggaaaga 5280 |
| tttttttaac cttaccacga aatacttaac tactgtttaa gtgaattgac ttatttcact 5340 |
| ttagtttttg aactgtgatt attggtatac tgttatatcc tcaacttgga tttatggtaa 5400 |
| ccccttttag ttcatggaga ccaaaatttg ggtatttat aatagtcagc gcaggaatgc 5460 |
| acatggaata tctacttgtc cttttgaacc tcacgagtca tccagaatgt atagacagga 5520 |
| aaagcatgtc ttatttaaaa ctgtaattta tgggctcagg atctgaccgc agtcccggga 5580 |
| gtaagcattt caaaggggga aggcagtgtg gtccctaccc tgtgtgaatg tgaggatgta 5640 |
| gacatccatc agtgcaactc gagctccatc ctcctccgat ttctaaggct ccagttttct 5700 |
| ggagggacag tcatcatgtt ttgatttatc tgggagaaaa ctgtggtgca cagcttgtga 5760 |
| ggagggcaag gttgtgacgt tcgagcttag ttctggtgtt attctgtctc ctcttctttg 5820 |
| tcatcagcca aaacgtggtt tttaaagaga gtcatgcagg ttagaaataa tgtcaaaaat 5880 |
| atttaggaat ttaataacct ttaagtcaga aactaaaaca aatactgaaa tattagctct 5940 |
| tcctacactt cgtgttcccc tttagctgcc tgaaaatcaa gattgctcct actcagatct 6000 |
| tctgagtggc taaaacttat ggatatgaaa aatgagattg aatgatgact atgctttgct 6060 |
| atcattgtta cctttcctca atactatttg gcaactactg ggactcttca gcacaaaagg 6120 |
| aatagatcta tgattgaccc tgattttaat tgtgaaatta tatgattcat atattttatg 6180 |
| aatcagaata accttcaaat aaaataaatc taagtcggtt aaaatggatt tcatgatttt 6240 |
| ccctcagaaa atgagtaacg gagtccacgg cgtgcaatgg taattataaa ttggtgatgc 6300 |
| ttgtttgcaa attgcccact cgtgataagt caacagccaa tatttaaaac tttgttcgtt 6360 |
| actggcttta ccctaacttt ctctagtcta ctgtcaatat cattttaatg taattgattg 6420 |

TABLE LIIe-continued

| Nucleotide sequence of transcript variant 282P1G03 v.6 |
|---|
| tatatagtct caagaatggt tggtgggcat gagttcctag agaactgtcc aagggttggg 6480 |
| aaaatccaaa ttctcttcct ggctccagca ctgattttgt acataaacat taggcaggtt 6540 |
| gcttaacctt tttatttcaa actctctcaa ctctaaagtg ctaataataa tctcagttac 6600 |
| cttatctttg tcacagggtg ttcttttttta tgaagaaaaa tttgaaaatg ataaaagcta 6660 |
| agatgccttc taacttcata agcaaacctt taactaatta tgtatctgaa agtcaccccc 6720 |
| acataccaac tcaacttttt tcctgtgaac acataaatat atttttatag aaaaacaaat 6780 |
| ctacataaaa taaatctact gtttagtgag cagtatgact tgtacatgcc attgaaaatt 6840 |
| attaatcaga agaaaattaa gcagggtctt tgctatacaa aagtgttttc cactaatttt 6900 |
| gcatgcgtat ttataagaaa aatgtgaatt tggtggtttt attctatcgg tataaaggca 6960 |
| tcgatatttt agatgcaccc gtgtttgtaa aaatgtagag cacaatggaa ttatgctgga 7020 |
| agtctcaaat aatatttttt tcctatttta tactcatgga agagataagc taaagagggg 7080 |
| acaataatga gaaatgttgg tgtgcttttc taagcattta aaacataatt gccaattgaa 7140 |
| accctaaata tgtttacata ccattaagat atgattcatg taacaatgtt aaattaatta 7200 |
| taatgggatt gggtttgtta tctgtggtag tatatatcct agtgttccta tagtgaaata 7260 |
| agtagggttc agccaaagct ttctttgttt tgtaccttaa attgttcgat tacgtcatca 7320 |
| aaagagatga aaggtatgta gaacaggttc acgtgattac ctttttcttt tggcttggat 7380 |
| taatattcat agtagaactt tataaaacgt gtttgtattg taggtggtgt ttgtattatg 7440 |
| cttatgacta tgtatggttt gaaaatattt tcattataca tgaaattcaa ctttccaaat 7500 |
| aaaagttcta cttcatgtaa tccaaaa 7527 |

TABLE LIIIe

Nucleotide sequence alignment of 282P1G03 v.1 (SEQ ID NO: 176) and 282P1G03 v.6 (SEQ ID NO: 177)

| | | | |
|---|---|---|---|
| v.1 | 1 | cggaccctgcgcgccccccgtcccggctcccggccggctcgggggagaagg | 50 |
| v.6 | 1 | CGGACCCTGCGCGCCCCCGTCCCGGCTCCCGGCCGGCTCGGGGGAGAAGG | 50 |
| v.1 | 51 | cgcccgaggggaggcgccggacagatcgcgtttcggaggcggcgcaggtg | 100 |
| v.6 | 51 | CGCCCGAGGGGAGGCGCCGGACAGATCGCGTTTCGGAGGCGGCGCAGGTG | 100 |
| v.1 | 101 | ctgtaaactgcaaaccataatcctgtcttaatactgcaaacaaatcatag | 150 |
| v.6 | 101 | CTGTAAACTGCAAACCATAATCCTGTCTTAATACTGCAAACAAATCATAG | 150 |
| v.1 | 151 | tggaactaaggggaacttaatttactgtttccaggttaactaaggtctca | 200 |
| v.6 | 151 | TGGAACTAAGGGGAACTTAATTTACTGTTTCCAGGTTAACTAAGGTCTCA | 200 |
| v.1 | 201 | gctgtaaaccaaaagtgagaggagacattaagattttcattcttaccggg | 250 |
| v.6 | 201 | GCTGTAAACCAAAAGTGAGAGGAGACATTAAGATTTTCATTCTTACCGGG | 250 |
| v.1 | 251 | ttgtcttcttcctgaagagcaatggagccgcttttacttggaagaggact | 300 |
| v.6 | 251 | TTGTCTTCTTCCTGAAGAGCAATGGAGCCGCTTTTACTTGGAAGAGGACT | 300 |
| v.1 | 301 | aatcgtatatctaatgttcctcctgttaaaattctcaaaagcaattgaaa | 350 |
| v.6 | 301 | AATCGTATATCTAATGTTCCTCCTGTTAAAATTCTCAAAAGCAATTGAAA | 350 |
| v.1 | 351 | taccatcttcagttcaacaggttccaacaatcataaaacagtcaaaagtc | 400 |

TABLE LIIIe-continued

Nucleotide sequence alignment of 282P1G03 v.1 (SEQ ID NO: 176) and 282P1G03 v.6 (SEQ ID NO: 177)

```
v.6   351  TACCATCTTCAGTTCAACAGGTTCCAACAATCATAAAACAGTCAAAAGTC  400

v.1   401  caagttgcctttcccttcgatgagtattttcaaattgaatgtgaagctaa  450
           ||||||||||||||||||||||||||||||||||||||||||||||||||
v.6   401  CAAGTTGCCTTTCCCTTCGATGAGTATTTTCAAATTGAATGTGAAGCTAA  450

v.1   451  aggaaatccagaaccaacattttcgtggactaaggatggcaacccttttt  500
           ||||||||||||||||||||||||||||||||||||||||||||||||||
v.6   451  AGGAAATCCAGAACCAACATTTTCGTGGACTAAGGATGGCAACCCTTTTT  500

v.1   501  atttcactgaccatcggataattccatcgaacaattcaggaacattcagg  550
           ||||||||||||||||||||||||||||||||||||||||||||||||||
v.6   501  ATTTCACTGACCATCGGATAATTCCATCGAACAATTCAGGAACATTCAGG  550

v.1   551  atcccaaacgaggggcacatatctcactttcaagggaaataccgctgctt  600
           ||||||||||||||||||||||||||||||||||||||||||||||||||
v.6   551  ATCCCAAACGAGGGGCACATATCTCACTTTCAAGGGAAATACCCCTGCTT  600

v.1   601  tgcttcaaataaactgggaatcgctatgtcagaagaaatagaatttatag  650
           ||||||||||||||||||||||||||||||||||||||||||||||||||
v.6   601  TCCTTCAAATAAACTGGGAATCGCTATGTCAGAAGAAATAGAATTTATAG  650

v.1   651  ttccaagtgttccaaaactcccaaaagaaaaaattgaccctcttgaagtg  700
           ||||||
v.6   651  TTCCAA--------------------------------------------  656

v.1   701  gaggagggagatccaattgtcctcccatgcaatcctcccaaaggcctccc  750

v.6   657  --------------------------------------------------  656

v.1   751  acctttacacatttattggatgaatattgaattagaacacatcgaacaag  800
                                       |||||||||||||||||||||
v.6   657  -----------------------------AATTAGAACACATCGAACAAG  677

v.1   801  atgaaagagtatacatgagccaaaagggagatctatacttcgcaaacgtg  850
           ||||||||||||||||||||||||||||||||||||||||||||||||||
v.6   678  ATGAAAGAGTATACATGAGCCAAAAGGGAGATCTATACTTCGCAAACGTG  727

v.1   851  gaagaaaaggacagtcgcaatgactactgttgctttgctgcatttccaag  900
           ||||||||||||||||||||||||||||||||||||||||||||||||||
v.6   728  GAAGAAAAGGACAGTCGCAATGACTACTGTTGCTTTGCTGCATTTCCAAG  777

v.1   901  attaaggactattgtacagaaaatgccaatgaaactaacagttaacagtt  950
           ||||||||||||||||||||||||||||||||||||||||||||||||||
v.6   778  ATTAAGGACTATTGTACAGAAAATGCCAATGAAACTAACAGTTAACAGTT  827

v.1   951  taaagcatgctaatgactcaagttcatccacagaaattggttccaaggca  1000
           ||||||||||||||||||||||||||||||||||||||||||||||||||
v.6   828  TAAAGCATGCTAATGACTCAAGTTCATCCACAGAAATTGGTTCCAAGGCA  877

v.1  1001  aattccatcaagcaaagaaaacccaaactgctgttgcctcccactgagag  1050
           ||||||||||||||||||||||||||||||||||||||||||||||||||
v.6   878  AATTCCATCAAGCAAAGAAAACCCAAACTGCTGTTGCCTCCCACTGAGAG  927

v.1  1051  tggcagtgagtcttcaattaccatcctcaaaggggaaatcttgctgcttg  1100
           ||||||||||||||||||||||||||||||||||||||||||||||||||
v.6   928  TGGCAGTGAGTCTTCAATTACCATCCTCAAAGGGGAAATCTTGCTGCTTG  977

v.1  1101  agtgttttgctgaaggcttgccaactccacaggttgattggaacaaaatt  1150
           ||||||||||||||||||||||||||||||||||||||||||||||||||
v.6   978  AGTGTTTTGCTGAAGGCTTGCCAACTCCACAGGTTGATTGGAACAAAATT  1027

v.1  1151  ggtggtgacttaccaaaggggagagaaacaaaagaaaattatggcaagac  1200
           ||||||||||||||||||||||||||||||||||||||||||||||||||
v.6  1028  GGTGGTGACTTACCAAAGGGGAGAGAAACAAAAGAAAATTATGGCAAGAC  1077

v.1  1201  tttgaagatagagaatgtctcctaccaggacaaaggaaattatcgctgca  1250
           ||||||||||||||||||||||||||||||||||||||||||||||||||
v.6  1078  TTTGAAGATAGAGAATGTCTCCTACCAGGACAAAGGAAATTATCGCTGCA  1127

v.1  1251  cagccagcaatttcttgggaacagccactcacgattttcacgttatagta  1300
           ||||||||||||||||||||||||||||||||||||||||||||||||||
v.6  1128  CAGCCAGCAATTTCTTGGGAACAGCCACTCACGATTTTCACGTTATAGTA  1177

v.1  1301  gaagagcctcctcgctggacaaagaagcctcagagtgctgtgtatagcac  1350
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

```
v.6  1178  GAAGAGCCTCCTCGCTGGACAAAGAAGCCTCAGAGTGCTGTGTATAGCAC  1227

v.1  1351  cggaagcaatggcatcttgttatgtgaggctgaaggagaacctcaaccca  1400
           ||||||||||||||||||||||||||||||||||||||||||||||||||
v.6  1228  CGGAAGCAATGGCATCTTGTTATGTGAGGCTGAAGGAGAACCTCAACCCA  1277

v.1  1401  caatcaagtggagagtcaatggctccccagttgacaatcatccatttgct  1450
           ||||||||||||||||||||||||||||||||||||||||||||||||||
v.6  1278  CAATCAAGTGGAGAGTCAATGGCTCCCCAGTTGACAATCATCCATTTGCT  1327

v.1  1451  ggtgatgttgtcttccccagggaaatcagttttaccaaccttcaaccaaa  1500
           ||||||||||||||||||||||||||||||||||||||||||||||||||
v.6  1328  GGTGATGTTGTCTTCCCCAGGGAAATCAGTTTTACCAACCTTCAACCAAA  1377

v.1  1501  tcatactgctgtgtaccagtgtgaagcctcaaatgtccatggaactatcc  1550
           ||||||||||||||||||||||||||||||||||||||||||||||||||
v.6  1378  TCATACTGCTGTGTACCAGTGTGAAGCCTCAAATGTCCATGGAACTATCC  1427

v.1  1551  ttgccaatgccaatattgatgttgtggatgtccgtccattgatacaaacc  1600
           ||||||||||||||||||||||||||||||||||||||||||||||||||
v.6  1428  TTGCCAATGCCAATATTGATGTTGTGGATGTCCGTCCATTGATACAAACC  1477

v.1  1601  aaagatggagaaaattacgctacagtggttgggtacagtgctttcttaca  1650
           ||||||||||||||||||||||||||||||||||||||||||||||||||
v.6  1478  AAAGATGGAGAAAATTACGCTACAGTGGTTGGGTACAGTGCTTTCTTACA  1527

v.1  1651  ttgcgagttctttgcttcacctgaggcagtcgtgtcctggcagaaggtgg  1700
           ||||||||||||||||||||||||||||||||||||||||||||||||||
v.6  1528  TTGCGAGTTCTTTGCTTCACCTGAGGCAGTCGTGTCCTGGCAGAAGGTGG  1577

v.1  1701  aagaagtgaaacccctggagggcaggcggtatcatatctatgaaaatggc  1750
           ||||||||||||||||||||||||||||||||||||||||||||||||||
v.6  1578  AAGAAGTGAAACCCCTGGAGGGCAGGCGGTATCATATCTATGAAAATGGC  1627

v.1  1751  acattgcagatcaacagaaccaccgaagaagatgctgggtcttactcatg  1800
           ||||||||||||||||||||||||||||||||||||||||||||||||||
v.6  1628  ACATTGCAGATCAACAGAACCACCGAAGAAGATGCTGGGTCTTACTCATG  1677

v.1  1801  ttgggtagaaaatgctataggaaaaactgcagtcacagccaatttggata  1850
           ||||||||||||||||||||||||||||||||||||||||||||||||||
v.6  1678  TTGGGTAGAAAATGCTATAGGAAAAACTGCAGTCACAGCCAATTTGGATA  1727

v.1  1851  ttagaaatgctacaaaacttagagtttctcctaagaatcctcgtatcccc  1900
           ||||||||||||||||||||||||||||||||||||||||||||||||||
v.6  1728  TTAGAAATCCTACAAAACTTAGAGTTTCTCCTAAGAATCCTCGTATCCCC  1777

v.1  1901  aaattgcatatgcttgaattacattgtgaaagcaaatgtgactcacattt  1950
           ||||||||||||||||||||||||||||||||||||||||||||||||||
v.6  1778  AAATTGCATATGCTTGAATTACATTGTGAAAGCAAATGTGACTCACATTT  1827

v.1  1951  gaaacacagtttgaagttgtcctggagtaaagatggagaagcctttgaaa  2000
           ||||||||||||||||||||||||||||||||||||||||||||||||||
v.6  1828  GAAACACAGTTTGAAGTTGTCCTGGAGTAAAGATGGAGAAGCCTTTGAAA  1877

v.1  2001  ttaatggcacagaagatggcaggataattattgatggagctaatttgacc  2050
           ||||||||||||||||||||||||||||||||||||||||||||||||||
v.6  1878  TTAATGGCACAGAAGATGGCAGGATAATTATTGATGGAGCTAATTTGACC  1927

v.1  2051  atatctaatgtaactttagaggaccaaggtatttactgctgttcagctca  2100
           ||||||||||||||||||||||||||||||||||||||||||||||||||
v.6  1928  ATATCTAATGTAACTTTAGAGGACCAAGGTATTTACTGCTGTTCAGCTCA  1977

v.1  2101  tactgctctagacagtgctgccgatataactcaagtaactgttcttgatg  2150
           ||||||||||||||||||||||||||||||||||||||||||||||||||
v.6  1978  TACTGCTCTAGACAGTGCTGCCGATATAACTCAAGTAACTGTTCTTGATG  2027

v.1  2151  ttccggatccaccagaaaaccttcacttgtctgaaagacagaacaggagt  2200
           ||||||||||||||||||||||||||||||||||||||||||||||||||
v.6  2028  TTCCGGATCCACCAGAAAACCTTCACTTGTCTGAAAGACAGAACAGGAGT  2077

v.1  2201  gttcggctgacctgggaagctggagctgaccacaacagcaatattagcga  2250
           ||||||||||||||||||||||||||||||||||||||||||||||||||
v.6  2078  GTTCGGCTGACCTGGGAAGCTGGAGCTGACCACAACAGCAATATTAGCGA  2127

v.1  2251  gtatattgttgaatttgaaggaaacaaagaagagcctggaaggtgggagg  2300
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

```
v.6  2128  GTATATTGTTGAATTTGAAGGAAACAAAGAAGAGCCTGGAAGGTGGGAGG  2177

v.1  2301  aactgaccagagtccaaggaaagaaaaccacagttatcttacctttggct  2350
           ||||||||||||||||||||||||||||||||||||||||||||||||||
v.6  2178  AACTGACCAGAGTCCAAGGAAAGAAAACCACAGTTATCTTACCTTTGGCT  2227

v.1  2351  ccatttgtgagataccagttcagggtcatagccgtgaacgaagtagggag  2400
           ||||||||||||||||||||||||||||||||||||||||||||||||||
v.6  2228  CCATTTGTGAGATACCAGTTCAGGGTCATAGCCGTGAACGAAGTAGGGAG  2277

v.1  2401  aagtcagcctagccagccgtcagaccatcatgaaacaccaccagcagctc  2450
           ||||||||||||||||||||||||||||||||||||||||||||||||||
v.6  2278  AAGTCAGCCTAGCCAGCCGTCAGACCATCATGAAACACCACCAGCAGCTC  2327

v.1  2451  cagataggaatccacaaaacataagggttcaagcctctcaacccaaggaa  2500
           ||||||||||||||||||||||||||||||||||||||||||||||||||
v.6  2328  CAGATAGGAATCCACAAAACATAAGGGTTCAAGCCTCTCAACCCAAGGAA  2377

v.1  2501  atgattataaagtgggagcctttgaaatccatggagcagaatggaccagg  2550
           ||||||||||||||||||||||||||||||||||||||||||||||||||
v.6  2378  ATGATTATAAAGTGGGAGCCTTTGAAATCCATGGAGCAGAATGGACCAGG  2427

v.1  2551  cctagagtacagagtgacctggaagccacagggagccccagtggagtggg  2600
           ||||||||||||||||||||||||||||||||||||||||||||||||||
v.6  2428  CCTAGAGTACAGAGTGACCTGGAAGCCACAGGGAGCCCCAGTGGAGTGGG  2477

v.1  2601  aagaagaaacagtcacaaaccacacattgcgggtgatgacgcctgctgtc  2650
           ||||||||||||||||||||||||||||||||||||||||||||||||||
v.6  2478  AAGAAGAAACAGTCACAAACCACACATTGCGGGTGATGACGCCTGCTGTC  2527

v.1  2651  tatgccccttatgatgtcaaggtccaggctatcaatcaactaggatctgg  2700
           ||||||||||||||||||||||||||||||||||||||||||||||||||
v.6  2528  TATGCCCCTTATGATGTCAAGGTCCAGGCTATCAATCAACTAGGATCTGG  2577

v.1  2701  gcctgaccctcagtoagtgactctctattctggagaagactatcctgata  2750
           ||||||||||||||||||||||||||||||||||||||||||||||||||
v.6  2578  GCCTGACCCTCAGTCAGTGACTCTCTATTCTGGAGAAGACTATCCTGATA  2627

v.1  2751  cagctccagtgatccatggggtggacgttataaacagtacattagttaaa  2800
           ||||||||||||||||||||||||||||||||||||||||||||||||||
v.6  2628  CAGCTCCAGTGATCCATGGGGTGGACGTTATAAACAGTACATTAGTTAAA  2677

v.1  2801  gttacctggtcaacagttccaaaggacagagtacatggacgtctgaaagg  2850
           ||||||||||||||||||||||||||||||||||||||||||||||||||
v.6  2678  GTTACCTGGTCAACAGTTCCAAAGGACAGAGTACATGGACGTCTGAAAGG  2727

v.1  2851  ctatcagataaattggtggaaaacaaaaagtctgttggatggaagaacac  2900
           ||||||||||||||||||||||||||||||||||||||||||||||||||
v.6  2728  CTATCAGATAAATTGGTGGAAAACAAAAAGTCTGTTGGATGGAAGAACAC  2777

v.1  2901  atcccaaagaagtgaacattictaagattttcaggacaaagaaactctgga 2950
           ||||||||||||||||||||||||||||||||||||||||||||||||||
v.6  2778  ATCCCAAAGAAGTGAACATTCTAAGATTTTCAGGACAAAGAAACTCTGGA  2827

v.1  2951  atggttccttccttagatgcctttagtgaatttcatttaacagtcttagc  3000
           ||||||||||||||||||||||||||||||||||||||||||||||||||
v.6  2828  ATGGTTCCTTCCTTAGATGCCTTTAGTGAATTTCATTTAACAGTCTTAGC  2877

v.1  3001  ctataactctaaaggagctggtcctgaaagtgagccttatatatttcaaa  3050
           ||||||||||||||||||||||||||||||||||||||||||||||||||
v.6  2878  CTATAACTCTAAAGGAGCTGGTCCTOAAAGTGAGCCTTATATATTTCAAA  2927

v.1  3051  caccagaaggagtacctgaacagccaacttttctaaaggtcatcaaagtt  3100
           ||||||||||||||||||||||||||||||||||||||||||||||||||
v.6  2928  CACCAGAAGGAGTACCTGAACAOCCAACTTTTCTAAAGGTCATCAAAGTT  2977

v.1  3101  gataaagacactgccactttatcttggggactacctaagaaattaaatgg  3150
           ||||||||||||||||||||||||||||||||||||||||||||||||||
v.6  2978  GATAAAGACACTGCCACTTTATCTTGGGGACTACCTAAGAAATTAAATGG  3027

v.1  3151  aaacttaactggctatcttttgcaatatcagataataaatgacacctacg  3200
           ||||||||||||||||||||||||||||||||||||||||||||||||||
v.6  3028  AAACTTAACTGGCTATCTTTTGCAATATCAGATAATAAATGACACCTACG  3077

v.1  3201  agattggagaattaaatgatattaacattacaactccatcaaagcccagc  3250
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

```
v.6  3078  AGATTGGAGAATTAAATGATATTAACATTACAACTCCATCAAAGCCCAGC  3127

v.1  3251  tggcacctctcaaacctgaatgcaactaccaagtacaaattctacttgag  3300
           ||||||||||||||||||||||||||||||||||||||||||||||||||
v.6  3128  TGGCACCTCTCAAACCTGAATGCAACTACCAAGTACAAATTCTACTTGAG  3177

v.1  3301  ggcttgcacttcacagggctgtggaaaaccgatcacggaggaaagctcca  3350
           ||||||||||||||||||||||||||||||||||||||||||||||||||
v.6  3178  GGCTTGCACTTCACAGGGCTGTGGAAAACCGATCACGGAGGAAAGCTCCA  3227

v.1  3351  ccttaggagaagggagtaaaggtatcgggaagatatcaggagtaaatctt  3400
           ||||||||||||||||||||||||||||||||||||||||||||||||||
v.6  3228  CCTTAGGAGAAGGGAGTAAAGGTATCGGGAAGATATCAGGAGTAAATCTT  3277

v.1  3401  actcaaaagactcacccaatagaggtatttgagccgggagctgaacatat  3450
           ||||||||||||||||||||||||||||||||||||||||||||||||||
v.6  3278  ACTCAAAAGACTCACCCAATAGAGGTATTTGAGCCGGGAGCTGAACATAT  3327

v.1  3451  agttcgcctaatgactaagaattggggcgataacgatagcatttttcaag  3500
           ||||||||||||||||||||||||||||||||||||||||||||||||||
v.6  3328  AGTTCGCCTAATGACTAAGAATTGGGGCGATAACGATAGCATTTTTCAAG  3377

v.1  3501  atgtaattgagacaagagggagagaatatgctggtttatatgatgacatc  3550
           ||||||||||||||||||||||||||||||||||||||||||||||||||
v.6  3378  ATGTAATTGAGACAAGAGGGAGAGAATATGCTGGTTTATATGATGACATC  3427

v.1  3551  tccactcaaggctggtttattggactgatgtgtgcgattgctcttctcac  3600
           ||||||||||||||||||||||||||||||||||||||||||||||||||
v.6  3428  TCCACTCAAGGCTGGTTTATTGGACTGATGTGTGCGATTGCTCTTCTCAC  3477

v.1  3601  actactattattaactgtttgctttgtgaagaggaatagaggtggaaagt  3650
           ||||||||||||||||||||||||||||||||||||||||||||||||||
v.6  3478  ACTACTATTATTAACTGTTTGCTTTGTGAAGAGGAATAGAGGTGGAAAGT  3527

v.1  3651  actcagttaaagaaaaggaagatttgcatccagacccagaaattcagtca  3700
           ||||||||||||||||||||||||||||||||||||||||||||||||||
v.6  3528  ACTCAGTTAAAGAAAAGGAAGATTTGCATCCAGACCCAGAAATTCAGTCA  3577

v.1  3701  gtaaaagatgaaacctttggtgaatacagtgacagtgatgaaaagcctct  3750
           ||||||||||||||||||||||||||||||||||||||||||||||||||
v.6  3578  GTAAAAGATGAAACCTTTGGTGAATACAGTGACAGTGATGAAAAGCCTCT  3627

v.1  3751  caaaggaagccttcggtcccttaatagggatatgcagcctactgaaagtg  3800
           ||||||||||||||||||||||||||||||||||||||||||||||||||
v.6  3628  CAAAGGAAGCCTTCGGTCCCTTAATAGGGATATGCAGCCTACTGAAAGTG  3677

v.1  3801  ctgacagcttagtcgaatacggagagggagaccatggtctcttcagtgaa  3850
           ||||||||||||||||||||||||||||||||||||||||||||||||||
v.6  3678  CTGACAGCTTAGTCGAATACGGAGAGGGAGACCATGGTCTCTTCAGTGAA  3727

v.1  3851  gatggatcatttattggtgcctacgctggatctaaggagaagggatctgt  3900
           ||||||||||||||||||||||||||||||||||||||||||||||||||
v.6  3728  GATGGATCATTTATTGGTGCCTACGCTGGATCTAAGGAGAAGGGATCTGT  3777

v.1  3901  tgaaagcaatggaagttctacagcaacttttccccttcgggcataaacac  3950
           ||||||||||||||||||||||||||||||||||||||||||||||||||
v.6  3778  TGAAAGCAATGGAAGTTCTACAGCAACTTTTCCCCTTCGGGCATAAACAC  3827

v.1  3951  aacatatgtaagcaacgctactggttcaccccaaccttccatatttatct  4000
           ||||||||||||||||||||||||||||||||||||||||||||||||||
v.6  3828  AACATATGTAAGCAACGCTACTGGTTCACCCCAACCTTCCATATTTATCT  3877

v.1  4001  gttcaaaggagcaagaactttcatataggaatagaaacatgctggccgaa  4050
           ||||||||||||||||||||||||||||||||||||||||||||||||||
v.6  3878  GTTCAAAGGAGCAAGAACTTTCATATAGGAATAGAAACATGCTGGCCGAA  3927

v.1  4051  gatttcatccagaagtcaacatcctgcaattatgttgaaaagagtagtac  4100
           ||||||||||||||||||||||||||||||||||||||||||||||||||
v.6  3928  GATTTCATCCAGAAGTCAACATCCTGCAATTATGTTGAAAAGAGTAGTAC  3977

v.1  4101  tttcttcaaaatataaaatgccaagcacttcaggcctatgttttgcttat  4150
           ||||||||||||||||||||||||||||||||||||||||||||||||||
v.6  3978  TTTCTTCAAAATATAAAATGCCAAGCACTTCAGGCCTATGTTTTGCTTAT  4027

v.1  4151  attgttttcaggtgctcaaaatgcaaaacacaaaacaaatcctgcattta  4200
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

```
v.6  4028  ATTGTTTTCAGGTGCTCAAAATGCAAAACACAAAACAAATCCTGCATTTA  4077

v.1  4201  gatacacctcaactaaatccaaagtccccattcagtatattccatatttg  4250
           ||||||||||||||||||||||||||||||||||||||||||||||||||
v.6  4078  GATACACCTCAACTAAATCCAAAGTCCCCATTCAGTATATTCCATATTTG  4127

v.1  4251  cctgattttactattcggtgtgtttgcacagatgttgctacttggtgggt  4300
           ||||||||||||||||||||||||||||||||||||||||||||||||||
v.6  4128  CCTGATTTTACTATTCGGTGTGTTTGCATAGATGTTGCTACTTGGTGGGT  4177

v.1  4301  ttttctccgtatgcacattggtatacagtctctgagaactggcttggtga  4350
           ||||||||||||||||||||||||||||||||||||||||||||||||||
v.6  4178  TTTTCTCCGTATGCACATTGGTATACAGTCTCTGAGAACTGGCTTGGTGA  4227

v.1  4351  ctttgcttcactacaggttaaaagaccataagcaaactggttatttaaaa  4400
           ||||||||||||||||||||||||||||||||||||||||||||||||||
v.6  4228  CTTTGCTTCACTACAGGTTAAAAGACCATAAGCAAACTGGTTATTTAAAA  4277

v.1  4401  tgtaaaaaggaatatgaaagtcttattaaaacacttcattgaaaatatac  4450
           ||||||||||||||||||||||||||||||||||||||||||||||||||
v.6  4278  TGTAAAAAGGAATATGAAAGTCTTATTAAAACACTTCATTGAAAATATAC  4327

v.1  4451  agtctaaatttattatttaaattttactagcaaaagtcttaggtgaacaa  4500
           ||||||||||||||||||||||||||||||||||||||||||||||||||
v.6  4328  AGTCTAAATTTATTATTTAAATTTTACTAGCAAAAGTCTTAGGTGAACAA  4377

v.1  4501  tcaactagtatttgttgagctcctatttgcccagagatggtcatatttaa  4550
           ||||||||||||||||||||||||||||||||||||||||||||||||||
v.6  4378  TCAACTAGTATTTGTTGAGCTCCTATTTGCCCAGAGATGGTCATATTTAA  4427

v.1  4551  acagaagtatacgtttttcagtttcaacatgaatttttttatttctgtca  4600
           ||||||||||||||||||||||||||||||||||||||||||||||||||
v.6  4428  ACAGAAGTATACGTTTTTCAGTTTCAACATGAATTTTTTTATTTCTGTCA  4477

v.1  4601  gttatgacatccacgagcatcactttttgtgtctgtttttttttttttct  4650
           ||||||||||||||||||||||||||||||||||||||||||||||||||
v.6  4478  GTTATGACATCCAC9AGCATCACTTTTTGTGTCTGTTTTTTTTTTTTTCT  4527

v.1  4651  tggactaaattcaactgcatggaagcggtggtcagaaggttgttttatac  4700
           ||||||||||||||||||||||||||||||||||||||||||||||||||
v.6  4528  TGGACTAAATTCAACTGCATGGAAGCGGTGGTCAGAAGGTTGTTTTATAC  4577

v.1  4701  gagaacaggcagaaagtgcccattgttcaggattctaatagctacatcta  4750
           ||||||||||||||||||||||||||||||||||||||||||||||||||
v.6  4578  GAGAACAGGCAGAAAGTGCCCATTGTTCAGGATTCTAATAGCTACATCTA  4627

v.1  4751  cttaatatcttcatttctaaattgactgcttttaccttttttctcatgttt  4800
           ||||||||||||||||||||||||||||||||||||||||||||||||||
v.6  4628  CTTAATATCTTCATTTCTAAATTGACTGCTTTTACCTTTTTCTCATGTTT  4677

v.1  4801  atataatggtatgcttgcatatatttcatgaatacattgtacatattatg  4850
           ||||||||||||||||||||||||||||||||||||||||||||||||||
v.6  4678  ATATAATGGTATGCTTGCATATATTTCATGAATACATTGTACATATTATG  4727

v.1  4851  ttaatatttacacaatttaaaatatagatgtgttttattttgaagtgaga  4900
           ||||||||||||||||||||||||||||||||||||||||||||||||||
v.6  4728  TTAATATTTACACAATTTAAAATATAGATGTGTTTTATTTTGAAGTGAGA  4777

v.1  4901  aaatgaacattaacaggcatgtttgtacagctagaatatattagtaagat  4950
           ||||||||||||||||||||||||||||||||||||||||||||||||||
v.6  4778  AAATGAACATTAACAGGCATGTTTGTACAGCTAGAATATATTAGTAAGAT  4827

v.1  4951  actgtttttcgtcattccagagctacaactaataacacgaggttccaaag  5000
           ||||||||||||||||||||||||||||||||||||||||||||||||||
v.6  4828  ACTGTTTTTCGTCATTCCAGAGCTACAACTAATAACACGAGGTTCCAAAG  4877

v.1  5001  ctgaagactttgtataaagtatttgggttttgttcttgtattgctttctt  5050
           ||||||||||||||||||||||||||||||||||||||||||||||||||
v.6  4878  CTGAAGACTTTGTATAAAGTATTTGGGTTTTGTTCTTGTATTGCTTTCTT  4927

v.1  5051  tcaacagtttcaaaataaaatatcatacaaatattgagggaaatgttttc  5100
           ||||||||||||||||||||||||||||||||||||||||||||||||||
v.6  4928  TCAACAGTTTCAAAATAAAATATCATACAAATATTGAGGGAAATGTTTTC  4977

v.1  5101  atatttttcaaaataggtttttattgttgaatgtacatctaccccagccc  5150
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

```
v.6  4978  ATATTTTTCAAAATAGGTTTTTATTGTTGAATGTACATCTACCCCAGCCC  5027

v.1  5151  ctcaaaagaaaaactgtttacatagaaattcctacacatacgtttgcgta  5200
           ||||||||||||||||||||||||||||||||||||||||||||||||||
v.6  5028  CTCAAAAGAAAAACTGTTTACATAGAAATTCCTACACATACGTTTGCGTA  5077

v.1  5201  tatgttattttaaacatctttgtggtgagaatttttccccgatattctc  5250
           ||||||||||||||||||||||||||||||||||||||||||||||||||
v.6  5078  TATGTTATTTTAAACATCTTTGTGGTGAGAATTTTTCCCCGATATTCTC  5127

v.1  5251  cttctgtcaaagtcagaacaaattcagggaatttattttctggcagttgt  5300
           ||||||||||||||||||||||||||||||||||||||||||||||||||
v.6  5128  CTTCTGTCAAAGTCAGAACAAATTCAGGGAATTTATTTTCTGGCAGTTGT  5177

v.1  5301  gctccagtccttttaaaattgtacatgaacatgttttagaaacaatatgg  5350
           ||||||||||||||||||||||||||||||||||||||||||||||||||
v.6  5178  GCTCCAGTCCTTTTAAAATTGTACATGAACATGTTTTAGAAACAATATGG  5227

v.1  5351  aggatgatgcatacatgtcggtcaagttcagcgctcgacattttatggaa  5400
           ||||||||||||||||||||||||||||||||||||||||||||||||||
v.6  5228  AGGATGATGCATACATGTCGGTCAAGTTCAGCGCTCGACATTTTATGGAA  5277

v.1  5401  agatttttttaaccttaccacgaaatacttaactactgtttaagtgaatt  5450
           ||||||||||||||||||||||||||||||||||||||||||||||||||
v.6  5278  AGATTTTTTTAACCTTACCACGAAATACTTAACTACTGTTTAAGTGAATT  5327

v.1  5451  gacttatttcactttagtttttgaactgtgattattggtatactgttata  5500
           ||||||||||||||||||||||||||||||||||||||||||||||||||
v.6  5328  GACTTATTTCACTTTAGTTTTTGAACTGTGATTATTGGTATACTGTTATA  5377

v.1  5501  tcctcaacttggatttatggtaaccccttttagttcatggagaccaaaat  5550
           ||||||||||||||||||||||||||||||||||||||||||||||||||
v.6  5378  TCCTCAACTTGGATTTATGGTAACCCCTTtTAGTTCATGGAGACCAAAAT  5427

v.1  5551  ttggggtatttataatagtcagcgcaggaatgcacatggaatatctactt  5600
           ||||||||||||||||||||||||||||||||||||||||||||||||||
v.6  5428  TTGGGGTATTTATAATAGTCAGCGCAGGAATGCACATGGAATATCTACTT  5477

v.1  5601  gtccttttgaacctcacgagtcatccagaatgtatagacaggaaaagcat  5650
           ||||||||||||||||||||||||||||||||||||||||||||||||||
v.6  5478  GTCCTTTTGAACCTCACGAGTCATCCAGAATGTATAGACAGGAAAAGCAT  5527

v.1  5651  gtcttatttaaaactgtaatttatgggctcaggatctgaccgcagtcccg  5700
           ||||||||||||||||||||||||||||||||||||||||||||||||||
v.6  5528  GTCTTATTTAAAACTGTAATTTATGGGCTCAGGATCTGACCGCAGTCCCG  5577

v.1  5701  ggagtaagcatttcaaaggggggaaggcagtgtggtccctaccctgtgtga  5750
           ||||||||||||||||||||||||||||||||||||||||||||||||||
v.6  5578  GGAGTAAGCATTTCAAAGGGGGAAGGCAGTGTGGTCCCTACCCTGTGTGA  5627

v.1  5751  atgtgaggatgtagacatccatcagtgcaactcgagctccatcctcctcc  5800
           ||||||||||||||||||||||||||||||||||||||||||||||||||
v.6  5628  ATGTGAGGATGTAGACATCCATCAGTGCAACTCGAGCTCCATCCTCCTCC  5677

v.1  5801  gatttctaaggctccagttttctggagggacagtcatcatgttttgattt  5850
           ||||||||||||||||||||||||||||||||||||||||||||||||||
v.6  5678  GATTTCTAAGGCTCCAGTTTTCTGGAGGGACAGTCATCATGTTTTGATTT  5727

v.1  5851  atctgggagaaaactgtggtgcacagcttgtgaggagggcaaggttgtga  5900
           ||||||||||||||||||||||||||||||||||||||||||||||||||
v.6  5728  ATCTGGGAGAAAACTGTGGTGCACAGCTTGTGAGGAGGGCAAGGTTGTGA  5777

v.1  5901  cgttcgagcttagttctggtgttattctgtctcctcttctttgtcatcag  5950
           ||||||||||||||||||||||||||||||||||||||||||||||||||
v.6  5778  CGTTCGAGCTTAGTTCTGGTGTTATTCTGTCTCCTCTTCTTTGTCATCAG  5827

v.1  5951  ccaaaacgtggtttttaaagagagtcatgcaggttagaaataatgtcaaa  6000
           ||||||||||||||||||||||||||||||||||||||||||||||||||
v.6  5828  CCAAAACGTGGTTTTTAAAGAGAGTCATGCAGGTTAGAAATAATGTCAAA  5877

v.1  6001  aatatttaggaatttaataacctttaagtcagaaactaaaacaaatactg  6050
           ||||||||||||||||||||||||||||||||||||||||||||||||||
v.6  5878  AATATTTAGGAATTTAATAACCTTTAAGTCAGAAACTAAAACAAATACTG  5927

v.1  6051  aaatattagctcttcctacacttcgtgttcccctttagctgcctgaaaat  6100
           ||||||||||||||||||||||||||||||||||||||||||||||||||
```

TABLE LIIIe-continued

Nucleotide sequence alignment of 282P1G03 v.1 (SEQ ID NO: 176) and 282P1G03 v.6 (SEQ ID NO: 177)

| | | | |
|---|---|---|---|
| v.6 | 5928 | AAATATTAGCTCTTCCTACACTTCGTGTTCCCCTTTAGCTGCCTGAAAAT | 5977 |
| v.1 | 6101 | caagattgctcctactcagatcttctgagtggctaaaacttatggatatg | 6150 |
| v.6 | 5978 | CAAGATTGCTCCTaCTCAGATCTTCTGAGTGGCTAAAACTTATGGATATG | 6027 |
| v.1 | 6151 | aaaaatgagattgaatgatgactatgctttgctatcattgttacctttcc | 6200 |
| v.6 | 6028 | AAAAATGAGATTGAATGATGACTATGCTTTGCTATCATTGTTACCTTTCC | 6077 |
| v.1 | 6201 | tcaatactatttggcaactactgggactcttcagcacaaaaggaatagat | 6250 |
| v.6 | 6078 | TCAATACTATTTGGCAACTACTGGGACTCTTCAGCACAAAAGGAATAGAT | 6127 |
| v.1 | 6251 | ctatgattgaccctgattttaattgtgaaattatatgattcatatatttt 6300 | |
| v.6 | 6128 | CTATGATTGACCCTGATTTTAATTGTGAAATTATATGATTCATATATTTT | 6177 |
| v.1 | 6301 | atgaatcagaataaccttcaaataaaataaatctaagtcggttaaaatgg | 6350 |
| v.6 | 6178 | ATGAATCAGAATAACCTTCAAATAAAATAAATCTAAGTCGGTTAAAATGG | 6227 |
| v.1 | 6351 | atttcatgattttccctcagaaaatgagtaacggagtccacggcgtgcaa | 6400 |
| v.6 | 6228 | ATTTCATGATTTTCCCTCAGAAAATGAGTAACgGAGTCCACGGCGTGCAA | 6277 |
| v.1 | 6401 | tggtaattataaattggtgatgcttgtttgcaaattgcccactcgtgata | 6450 |
| v.6 | 6278 | TGGTAATTATAAATTGGTGATGCTTGTTTGCAAATTGCCCACTCGTGATA | 6327 |
| v.1 | 6451 | agtcaacagccaatatttaaaactttgttcgttactggctttaccctaac | 6500 |
| v.6 | 6328 | AGTCAACAGCCAATATTTAAAACTTTGTTCGTTACTGGCTTTACCCTAAC | 6377 |
| v.1 | 6501 | tttctctagtctactgtcaatatcattttaatgtaattgattgtatatag | 6550 |
| v.6 | 6378 | TTTCTCTAGTCTACTGTCAATATCATTTTAATGTAATTGATTGTATATAG | 6427 |
| v.1 | 6551 | tctcaagaatggttggtgggcatgagttcctagagaactgtccaagggtt | 6600 |
| v.6 | 6428 | TCTCAAGAATGGTTGGTGGGCATGAGTTCCTAGAGAACTGTCCAAGGGTT | 6477 |
| v.1 | 6601 | gggaaaatccaaattctcttcctggctccagcactgattttgtacataaa | 6650 |
| v.6 | 6478 | GGGAAAATCCAAATTCTCTTCCTGGCTCCAGCACTGATTTTGTACATAAA | 6527 |
| v.1 | 6651 | cattaggcaggttgcttaaccttttatttcaaactctctcaactctaaa | 6700 |
| v.6 | 6528 | CATTAGGCAGGTTGCTTAACCTTTTTATTTCAAACTCTCTCAACTCTAAA | 6577 |
| v.1 | 6701 | gtgctaataataatctcagttaccttatctttgtcacagggtgttctttt | 6750 |
| v.6 | 6578 | GTGCTAATAATAATCTCAGTTACCTTATCTTTGTCACAGGGTGTTCTTTT | 6627 |
| v.1 | 6751 | ttatgaagaaaaatttgaaaatgataaaagctaagatgccttctaacttc | 6800 |
| v.6 | 6628 | TTATGAAGAAAAATTTGAAAATGATAAAAGCTAAGATGCCTTCTAACTTC | 6677 |
| v.1 | 6801 | ataagcaaacctttaactaattatgtatctgaaagtcacccccacatacc | 6850 |
| v.6 | 6678 | ATAAGCAAACCTTTAACTAATTATGTATCTGAAAGTCACCCCCACATACC | 6727 |
| v.1 | 6851 | aactcaactttttttcctgtgaacacataaatatatttttatagaaaaaca | 6900 |
| v.6 | 6728 | AACTCAACTTTTTTCCTGTGAACACATAAATATATTTTTATAGAAAAACA | 6777 |
| v.1 | 6901 | aatctacataaaataaatctactgtttagtgagcagtatgacttgtacat | 6950 |
| v.6 | 6778 | AATCTACATAAAATAAATCTACTGTTTAGTGAGCAGTATGACTTGTACAT | 6827 |
| v.1 | 6951 | gccattgaaaattattaatcagaagaaaattaagcagggtctttgctata | 7000 |
| v.6 | 6828 | GCCATTGAAAATTATTAATCAGAAGAAAATTAAGCAGGGTCTTTGCTATA | 6877 |
| v.1 | 7001 | caaaagtgttttccactaattttgcatgcgtatttataagaaaaatgtga | 7050 |

TABLE LIIIe-continued

Nucleotide sequence alignment of 282P1G03 v.1 (SEQ ID NO: 176) and 282P1G03 v.6 (SEQ ID NO: 177)

```
               ||||||||||||||||||||||||||||||||||||||||||||||||||
v.6  6878  CAAAAGTGTTTTCCACTAATTTTGCATGCGTATTTATAAGAAAAATGTGA  6927

v.1  7051  atttggtggttttattctatcggtataaaggcatcgatattttagatgca  7100
           ||||||||||||||||||||||||||||||||||||||||||||||||||
v.6  6928  ATTTGGTGGTTTTATTCTATCGGTATAAAGGCATCGATATTTTAGATGCA  6977

v.1  7101  cccgtgtttgtaaaaatgtagagcacaatggaattatgctggaagtctca  7150
           ||||||||||||||||||||||||||||||||||||||||||||||||||
v.6  6978  CCCGTGTTTGTAAAAATGTAGAGCACAATGGAATTATGCTGGAAGTCTCA  7027

v.1  7151  aataatatttttttcctattttatactcatggaagagataagctaaagag  7200
           ||||||||||||||||||||||||||||||||||||||||||||||||||
v.6  7028  AATAATATTTTTTTCCTATTTTATACTCATGGAGAGATAAGCTAAAGAG   7077

v.1  7201  gggacaataatgagaaatgttggtgtgcttttctaagcatttaaaacata  7250
           ||||||||||||||||||||||||||||||||||||||||||||||||||
v.6  7078  GGGACAATAATGAGAAATGTTGGTGTGCTTTTCTAAGCATTTAAAACATA  7127

v.1  7251  attgccaattgaaaccctaaatatgtttacataccattaagatatgattc  7300
           ||||||||||||||||||||||||||||||||||||||||||||||||||
v.6  7128  ATTGCCAATTGAAACCCTAAATATGTTTACATACCATTAAGATATGATTC  7177

v.1  7301  atgtaacaatgttaaattaattataatgggattgggtttgttatctgtgg  7350
           ||||||||||||||||||||||||||||||||||||||||||||||||||
v.6  7178  ATGTAACAATGTTAAATTAATTATAATGGGATTGGGTTTGTTATCTGTGG  7227

v.1  7351  tagtatatatcctagtgttcctatagtgaaataagtagggttcagccaaa  7400
           ||||||||||||||||||||||||||||||||||||||||||||||||||
v.6  7228  TAGTATATATCCTAGTGTTCCTATAGTGAAATAAGTAGGGTTCAGCCAAA  7277

v.1  7401  gctttctttgttttgtaccttaaattgttcgattacgtcatcaaaagaga  7450
           ||||||||||||||||||||||||||||||||||||||||||||||||||
v.6  7278  GCTTTCTTTGTTTTGTACCTTAAATTGTTCGATTACGTCATCAAAAGAGA  7327

v.1  7451  tgaaaggtatgtagaacaggttcacgtgattaccttttcttttggcttg  7500
           ||||||||||||||||||||||||||||||||||||||||||||||||||
v.6  7328  TGAAAGGTATGTAGAACAGGTTCACGTGATTACCTTTTTCTTTTGGCTTG  7377

v.1  7501  gattaatattcatagtagaactttataaaacgtgtttgtattgtaggtgg  7550
           ||||||||||||||||||||||||||||||||||||||||||||||||||
v.6  7378  GATTAATATTCATAGTAGAACTTTATAAAACGTGTTTGTATTGTAGGTGG  7427

v.1  7551  tgtttgtattatgcttatgactatgtatggtttgaaaatattttcattat  7600
           ||||||||||||||||||||||||||||||||||||||||||||||||||
v.6  7428  TGTTTGTATTATGCTTATGACTATGTATGGTTTGAAAATATTTTCATTAT  7477

v.1  7601  acatgaaattcaactttccaaataaaagttctacttcatgtaatccaaaa  7650
           ||||||||||||||||||||||||||||||||||||||||||||||||||
v.6  7478  ACATGAAATTCAACTTTCCAAATAAAAGTTCTACTTCATGTAATCCAAAA  7527
```

TABLE LIVe

Peptide sequences of protein coded by 282P1G03 v.6

(SEQ ID NO:178)

```
MEPLLLGRGL IVYLMFLLLK FSKAIEIPSS VQQVPTIIKQ SKVQVAFPFD EYFQIECEAK  60

GNPEPTFSWT KDGNPFYFTD HRIIPSNNSG TFRIPNEGHI SHFQGKYRCF ASNKLGIANS  120

EEIEFIVPKL EHIEQDERVY MSQKGDLYFA NVEEKDSRND YCCFAAFPRL RTIVQKMPMK  180

LTVNSLKHAN DSSSSTEIGS KANSIKQRKP KLLLPPTESG SESSITTLKG EILLLECFAE  240

GLPTPQVDWN KIGGDLPKGR ETKENYGKTL KIENVSYQDK GNYRCTASNF LGTATHDFHV  300

IVEEPPRWTK KPQSAVYSTG SNGILLCEAE GEPQPTIKWR VNGSPVDNHP FAGDVVFPRE  360

ISFTNLQPMH TAVYQCEASN VHGTILANAN IDVVDVRPLI QTKDGENYAT VVGYSAFLHC  420

EFFASPEAVV SWQKVEEVKP LEGRRYHIYE NGTLQINRTT EEDAGSYSCW VENAIGKTAV  480

TANLDIRNAT KLRVSPKNPR IPKHHMLELH CESKCDSHLK HSLKLSWSKD GEAFEINGTE  540
```

TABLE LIVe-continued

| Peptide sequences of protein coded by 282P1G03 v.6 |
|---|

```
DGRIIIDGAN LTISNVTLED QGIYCCSAHT ALDSAADITQ VTVLDVPDPP ENLHLSERQN  600

RSVRLTWEAG ADHMSNISEY IVEFEGNKEE PGRWEELTRV QGKKTTVILP LAPFVRYQFR  660

VIAVNEVGRS QPSQPSDHHE TPPAAPDRNP QNIRVQASQP KEMIIKWEPL KSMEQNGPGL  720

EYRVTWKPQG APVEWEEETV TNHTLRVMTP AVYAPYDVKV QAINQLGSGP DPQSVTLYSG  780

EDYPDTAPVI HGVDVINSTL VKVTWSTVPK DRVHGRLKGY QINWWKTKSL LDGRTHPKEV  840

NILRFSGQRN SGMVPSLDAF SEFHLTVLAY NSKGAGPESE PYIFQTPEGV PEQPTFLKVI  900

KVDKDTATLS WGLPKKLNGN LTGYLLQYQI INDTYEIGEL NDINITTPSK PSWHLSHLNA  960

TTKYKFYLPA CTSQGCGKPI TEESSTLGEG SKGIGKISGV NLTQKTHPTE VFEPGAEHIV  1020

RLMTKNWGDM DSIFQDVIET RGREYAGLYD DISTQGWFIG LMCAIALLTL LLLTVCFVKR  1080

NRGGKYSVKE KEDLHPDPEI QSVKDETFGE YSDSDEKPLK GSLRSLNRDM QPTESADSLV  1140

EYGEGDHGLF SEDGSFIGAY AGSKEKGSVE SNGSSTATFP LRA 1183
```

TABLE LVe

| Amino acid sequence alignment of 282P1G03 v.1 (SEQ ID NO: 179) and 282P1G03 v.6 (SEQ ID NO: 180) |
|---|

```
v.1    1  MEPLLLGRGLIVYLMFLLLKFSKAIEIPSSVQQVPTIIKQSKVQVAFPFD   50
          ||||||||||||||||||||||||||||||||||||||||||||||||||
v.6    1  MEPLLLGRGLIVYLMFLLLKFSKAIEIPSSVQQVPTIIKQSKVQVAFPFD   50

v.1   51  EYFQIECEAKGNPEPTFSWTKDGNPFYFTDHRIIPSNNSGTFRIPNEGHI  100
          ||||||||||||||||||||||||||||||||||||||||||||||||||
v.6   51  EYFQIECEAKGNPEPTFSWTKDGNPFYFTDHRIIPSNNSGTFRIPNEGHI  100

v.1  101  SHFQGKYRCFASNKLGIANSEEIEFIVPSVPKLPKEKIDPLEVEEGDPIV  150
          |||||||||||||||||| |||||||||
v.6  101  SHFQGKYRCFASNKLGIAMSEEIEFIVP----------------------  128

v.1  151  LPCNPPKGLPPLHIYWMNIELEHIEQDERVYMSQKGDLYFANVEEKDSRN  200
                             :||||||||||||||||||||||||||||||
v.6  129  -------------------KLEHIEQDERVYMSQKGDLYFANVEEKDSRN  159

v.1  201  DYCCFAAFPRLRTIVQKMPMKLTVHSLKHANDSSSSTEIGSKANSIKQRK  250
          ||||||||||||||||||||||||||||||||||||||||||||||||||
v.6  160  DYCCFAAPPRLRTIVQKMPMKLTVNSLKHANDSSSSTEIGSKANSIKQRK  209

v.1  251  PKLLLPPTESGSESSITILKGEILLLECFAEGLPTPQVDWNKIGGDLPKG  300
          ||||||||||||||||||||||||||||||||||||||||||||||||||
v.6  210  PKLLLPPTESGSESSITILKGEILLLECFAEGLPTPQVDWNKIGGDLPKG  259

v.1  301  RETKENYGKTLKIENVSYQDKGNYRCTASNFLGTATHDFHVIVEEPPRWT  350
          ||||||||||||||||||||||||||||||||||||||||||||||||||
v.6  260  RETKENYGKTLKIENVSYQDKGNYRCTASNFLGTATHDFHVIVEEPPRWT  309

v.1  351  KKPQSAVYSTGSNGILLCEAEGEPQPTIKWRVNGSPVDNHPFAGDVVFPR  400
          ||||||||||||||||||||||||||||||||||||||||||||||||||
v.6  310  KKPQSAVYSTGSNGILLCEAEGEPQPTIKWRVNGSPVDNHPFAGDVVFPR  359

v.1  401  EISFTNLQPNHTAVYQCEASNVHGTILANANIDVVDVRPLIQTKDGENYA  450
          ||||||||||||||||||||||||||||||||||||||||||||||||||
v.6  360  EISFTNLQPNHTAVYQCEASNVHGTILANANIDVVDVRPLIQTKDGENYA  409

v.1  451  TVVGYSAFLHCEFFASPEAVVSWQKVEEVKPLEGRRYHIYENGTLQINRT  500
          ||||||||||||||||||||||||||||||||||||||||||||||||||
v.6  410  TVVGYSAFLHCEFFASPEAVVSWQKVEEVKPLEGRRYHIYENGTLQINRT  459

v.1  501  TEEDAGSYSCWVENAIGKTAVTANLDIRNATKLRVSPKNPRIPKLHMLEL  550
          ||||||||||||||||||||||||||||||||||||||||||||||||||
v.6  460  TEEDAGSYSCWVENAIGKTAVTANLDIRNATKLRVSPKNPRIPKLHMLEL  509

v.1  551  HCESKCDSHLKHSLKLSWSKDGEAFEINGTEDGRIIIDGANLTISNVTLE  600
          ||||||||||||||||||||||||||||||||||||||||||||||||||
```

TABLE LVe-continued

Amino acid sequence alignment of 282P1G03 v.1 (SEQ ID NO: 179) and 282P1G03 v.6 (SEQ ID NO: 180)

```
v.6   510  HCESKCDSHLKHSLKLSWSKDGEAFEINGTEDGRIIIDGANLTISNVTLE   559

v.1   601  DQGIYCCSAHTALDSAADITQVTVLDVPDPPENLHLSERQNRSVRLTWEA   650
           |||||||||||||||||||||||||||||||||||||||||||||||||||
v.6   560  DQGIYCCSAHTALDSAADITQVTVLDVPDPPEILHLSERQNRSVRLTWEA   609

v.1   651  GADHNSNISEYIVEFEGMKEEPGRWEELTRVQGKKTTVILPLAPFVRYQF   700
           |||||||||||||||||||||||||||||||||||||||||||||||||||
v.6   610  GADHNSNISEYIVEFEGNKEEPGRWEELTRVQGKKTTVILPLAPFVRYQF   659

v.1   701  RVIAVNEVGRSQPSQPSDHHETPPAAPDRNPQNIRVQASQPKEMIIKWEP   750
           |||||||||||||||||||||||||||||||||||||||||||||||||||
v.6   660  RVIAVNEVGRSQPSQPSDHHETPPAAPDRNPQNIRVQASQPKEMIIKWEP   709

v.1   751  LKSMEQNGPGLEYRVTWKPQGAPVEWEEETVTNHTLRVMTPAVYAPYDVK   800
           |||||||||||||||||||||||||||||||||||||||||||||||||||
v.6   710  LKSMEQNGPGLEYRVTWKPQGAPVEWEEETVTNHTLRVMTPAVYAPYDVK   759

v.1   801  VQAINQLGSGPDPQSVTLYSGEDYPDTAPVIHGVDVINSTLVKVTWSTVP   850
           |||||||||||||||||||||||||||||||||||||||||||||||||||
v.6   760  VQAINQLGSGPDPQSVTLYSGEDYPDTAPVIHGVDVINSTLVKVTWSTVP   809

v.1   851  KDRVHGRLKGYQINWWKTKSLLDGRTHPKEVNILRFSGQRNSGMVPSLDA   900
           |||||||||||||||||||||||||||||||||||||||||||||||||||
v.6   810  KDRVHGRLKGYQINWWKTKSLLDGRTHPKEVNILRFSGQRNSGMVPSLDA   859

v.1   901  FSEFHLTVLAYNSKGAGPESEPYIFQTPEGVPEQPTFLKVIKVDKDTATL   950
           |||||||||||||||||||||||||||||||||||||||||||||||||||
v.6   860  FSEFHLTVLAYNSKGAGPESEPYIFQTPEGVPEQPTFLKVIKVDKDTATL   909

v.1   951  SWGLPKKLNGNLTGYLLQYQITNDTYEIGELNDINITTPSKPSWHLSNLN  1000
           |||||||||||||||||||||||||||||||||||||||||||||||||||
v.6   910  SWGLPKKLNGNLTGYLLQYQIINDTYEIGELNDIHITTPSKPSWHLSNLN   959

v.1  1001  ATTKYKFYLPACTSQGCGKPITEESSTLGEGSKGIGKISGVNLTQKTHPI  1050
           |||||||||||||||||||||||||||||||||||||||||||||||||||
v.6   960  ATTKYKFYLPACTSQGCGKPITEESSTLGEGSKGIGKISGVNLTQKTHPI  1009

v.1  1051  EVFEPGAEHIVRLMTKNWGDNDSIFQDVIETRGREYAGLYDDISTQGWFI  1100
           |||||||||||||||||||||||||||||||||||||||||||||||||||
v.6  1010  EVFEPGAEHIVRLMTKNWGDNDSIFQDVIETRGREYAGLYDDISTQCWFI  1059

v.1  1101  GLMCAIALLTLLLLTVCFVKRNRGGKYSVKEKEDLHPDPEIQSVKDETFG  1150
           |||||||||||||||||||||||||||||||||||||||||||||||||||
v.6  1060  GLMCAIALLTLLLLTVCFVKRNRGGKYSVKEKEDLHPDPEIQSVKDETFG  1109

v.1  1151  EYSDSDEKPLKGSLRSLNRDMQPTESADSLVEYGEGDHGLFSEDGSFIGA  1200
           |||||||||||||||||||||||||||||||||||||||||||||||||||
v.6  1110  EYSDSDEKPLKGSLRSLNRDMQPTESADSLVEYGEGDHGLFSEDGSFIGA  1159

v.1  1201  YAGSKEKGSVESNGSSTATFPLPA 1224
           ||||||||||||||||||||||||
v.6  1160  YAGSKEKGSVESW3SSTATFPLRA 1183
```

TABLE LIIf

Nucleotide sequence of transcript variant 282P1G03 v.7

(SEQ ID NO:181)

```
cggaccctgc gcgcccccgt cccggctccc ggccggctcg ggggagaagg cgcccgaggg  60

gaggcgccgg acagatcgcg tttcggaggc ggcgcaggtg ctgtaaactg caaaccataa  120

tcctgtctta atactgcaaa caaatcatag tggaactaag ggaacttaa tttactgttt  180

ccaggttaac taaggtctca gctgtaaacc aaaagtgaga ggagacatta agattttcat  240

tcttaccggg ttgtcttctt cctgaagagc aatggagccg cttttacttg gaagaggact  300

aatcgtatat ctaatgttcc tcctgttaaa attctcaaaa gcaattgaaa taccatcttc  360

agttcaacag gttccaacaa tcataaaaca gtcaaaagtc caagttgcct ttcccttcga  420
```

TABLE LIIf-continued

| Nucleotide sequence of transcript variant 282P1G03 v.7 |
|---|
| tgagtatttt caaattgaat gtgaagctaa aggaaatcca gaaccaacat tttcgtggac 480 |
| taaggatggc aacccttttt atttcactga ccatcggata attccatcga acaattcagg 540 |
| aacattcagg atcccaaacg aggggcacat atctcacttt caagggaaat accgctgctt 600 |
| tgcttcaaat aaactgggaa tcgctatgtc agaagaaata gaatttatag ttccaagtgt 660 |
| tccaaaactc ccaaaagaaa aaattgaccc tcttgaagtg gaggagggag atccaattgt 720 |
| cctcccatgc aatcctccca aaggcctccc acctttacac atttattgga tgaatattga 780 |
| attagaacac atcgaacaag atgaaagagt atacatgagc caaaagggag atctatactt 840 |
| cgcaaacgtg gaagaaaagg acagtcgcaa tgactactgt tgctttgctg catttccaag 900 |
| attaaggact attgtacaga aaatgccaat gaaactaaca gttaacagtt taaagcatgc 960 |
| taatgactca agttcatcca cagaaattgg ttccaaggca aattccatca agcaaagaaa 1020 |
| acccaaactg ctgttgcctc ccactgagag tggcagtgag tcttcaatta ccatcctcaa 1080 |
| aggggaaatc ttgctgcttg agtgttttgc tgaaggcttg ccaactccac aggttgattg 1140 |
| gaacaaaatt ggtggtgact taccaaaggg gagagaaaca aaagaaaatt atggcaagac 1200 |
| tttgaagata gagaatgtct cctaccagga caaaggaaat tatcgctgca cagccagcaa 1260 |
| tttcttggga acagccactc acgattttca cgttatagta gaagataaca tctctcatga 1320 |
| gctcttcact ttacatccag agcctcctcg ctggacaaag aagcctcaga gtgctgtgta 1380 |
| tagcaccgga agcaatggca tcttgttatg tgaggctgaa ggagaacctc aacccacaat 1440 |
| caagtggaga gtcaatggct ccccagttga caatcatcca tttgctggtg atgttgtctt 1500 |
| ccccagggaa atcagtttta ccaaccttca accaaatcat actgctgtgt accagtgtga 1560 |
| agcctcaaat gtccatggaa ctatccttgc caatgccaat attgatgttg tggatgtccg 1620 |
| tccattgata caaaccaaag atggagaaaa ttacgctaca gtggttgggt acagtgcttt 1680 |
| cttacattgc gagttctttg cttcacctga ggcagtcgtg tcctggcaga aggtggaaga 1740 |
| agtgaaaccc ctggagggca ggcggtatca tatctatgaa aatggcacat tgcagatcaa 1800 |
| cagaaccacc gaagaagatg ctgggtctta ctcatgttgg gtagaaaatg ctataggaaa 1860 |
| aactgcagtc acagccaatt tggatattag aaatgctaca aaacttagag tttctcctaa 1920 |
| gaatcctcgt atccccaaat tgcatatgct tgaattacat tgtgaaagca aatgtgactc 1980 |
| acatttgaaa cacagtttga agttgtcctg gagtaaagat ggagaagcct ttgaaattaa 2040 |
| tggcacagaa gatggcagga taattattga tggagctaat ttgaccatat ctaatgtaac 2100 |
| tttagaggac caaggtattt actgctgttc agctcatact gctctagaca gtgctgccga 2160 |
| tataactcaa gtaactgttc ttgatgttcc ggatccacca gaaaaccttc acttgtctga 2220 |
| aagacagaac aggagtgttc ggctgacctg ggaagctgga gctgaccaca acagcaatat 2280 |
| tagcgagtat attgttgaat ttgaaggaaa caaagaagag cctggaaggt gggaggaact 2340 |
| gaccagagtc caaggaaaga aaaccacagt tatcttacct ttggctccat ttgtgagata 2400 |
| ccagttcagg gtcatagccg tgaacgaagt agggagaagt cagcctagcc agccgtcaga 2469 |
| ccatcatgaa acaccaccag cagctccaga taggaatcca caaaacataa gggttcaagc 2520 |
| ctctcaaccc aaggaaatga ttataaagtg ggagcctttg aaatccatgg agcagaatgg 2580 |
| accaggccta gagtacagag tgacctggaa gccacaggga gccccagtgg agtgggaaga 2640 |
| agaaacagtc acaaaccaca cattgcgggt gatgacgcct gctgtctatg ccccttatga 2700 |
| tgtcaaggtc caggctatca atcaactagg atctgggcct gaccctcagt cagtgactct 2760 |

TABLE LIIf-continued

| Nucleotide sequence of transcript variant 282P1G03 v.7 |
|---|
| ctattctgga gaagactatc ctgatacagc tccagtgatc catggggtgg acgttataaa 2820 |
| cagtacatta gttaaagtta cctggtcaac agttccaaag gacagagtac atggacgtct 2880 |
| gaaaggctat cagataaatt ggtggaaaac aaaaagtctg ttggatggaa gaacacatcc 2940 |
| caaagaagtg aacattctaa gattttcagg acaaagaaac tctggaatgg ttccttcctt 3000 |
| agatgccttt agtgaatttc atttaacagt cttagcctat aactctaaag gagctggtcc 3060 |
| tgaaagtgag ccttatatat ttcaaacacc agaaggagta cctgaacagc caacttttct 3120 |
| aaaggtcatc aaagttgata aagacactgc cactttatct tggggactac ctaagaaatt 3180 |
| aaatggaaac ttaactggct atcttttgca atatcagata ataaatgaca cctacgagat 3240 |
| tggagaatta aatgatatta acattacaac tccatcaaag cccagctggc acctctcaaa 3300 |
| cctgaatgca actaccaagt acaaattcta cttgagggct tgcacttcac agggctgtgg 3360 |
| aaaaccgatc acggaggaaa gctccacctt aggagaaggg agtaaaggta tcgggaagat 3420 |
| atcaggagta aatcttactc aaaagactca cccaatagag gtatttgagc cgggagctga 3480 |
| acatatagtt cgcctaatga ctaagaattg gggcgataac gatagcattt ttcaagatgt 3540 |
| aattgagaca agagggagag aatatgctgg tttatatgat gacatctcca ctcaaggctg 3600 |
| gtttattgga ctgatgtgtg cgattgctct tctcacacta ctattattaa ctgtttgctt 3660 |
| tgtgaagagg aatagaggtg gaaagtactc agttaaagaa aaggaagatt tgcatccaga 3720 |
| cccagaaatt cagtcagtaa aagatgaaac ctttggtgaa tacagtgaca gtgatgaaaa 3780 |
| gcctctcaaa ggaagccttc ggtcccttaa tagggatatg cagcctactg aaagtgctga 3840 |
| cagcttagtc gaatacggag agggagacca tggtctcttc agtgaagatg gatcatttat 3900 |
| tggtgcctac gctggatcta aggagaaggg atctgttgaa agcaatggaa gttctacagc 3960 |
| aacttttccc cttcgggcat aaacacaaca tatgtaagca acgctactgg ttcaccccaa 4020 |
| ccttccatat ttatctgttc aaaggagcaa gaactttcat ataggaatag aaacatgctg 4080 |
| gccgaagatt tcatccagaa gtcaacatcc tgcaattatg ttgaaaagag tagtactttc 4140 |
| ttcaaaatat aaaatgccaa gcacttcagg cctatgtttt gcttatattg ttttcaggtg 4200 |
| ctcaaaatgc aaaacacaaa acaaatcctg catttagata cacctcaact aaatccaaag 4260 |
| tccccattca gtatattcca tatttgcctg attttactat tcggtgtgtt tgcatagatg 4320 |
| ttgctacttg gtgggttttt ctccgtatgc acattggtat acagtctctg agaactggct 4380 |
| tggtgacttt gcttcactac aggttaaaag accataagca aactggttat ttaaaatgta 4440 |
| aaaaggaata tgaaagtctt attaaaacac ttcattgaaa atatacagtc taaatttatt 4500 |
| atttaaattt tactagcaaa agtcttaggt gaacaatcaa ctagtatttg ttgagctcct 4560 |
| atttgcccag agatggtcat atttaaacag aagtatacgt tttcagtttt caacatgaat 4620 |
| ttttttattt ctgtcagtta tgacatccac gagcatcact ttttgtgtct gttttttttt 4680 |
| ttttcttgga ctaaattcaa ctgcatggaa gcggtggtca gaaggttgtt ttatacgaga 4740 |
| acaggcagaa agtgcccatt gttcaggatt ctaatagcta catctactta atatcttcat 4800 |
| ttctaaattg actgctttta cctttttctc atgtttatat aatggtatgc ttgcatatat 4860 |
| ttcatgaata cattgtacat attatgttaa tatttacaca atttaaaata tagatgtgtt 4920 |
| ttattttgaa gtgagaaaat gaacattaac aggcatgttt gtacagctag aatatattag 4980 |
| taagatactg tttttcgtca ttccagagct acaactaata acacgaggtt ccaaagctga 5040 |

TABLE LIIf-continued

| Nucleotide sequence of transcript variant 282P1G03 v.7 |
|---|
| agactttgta taaagtattt gggttttgtt cttgtattgc tttctttcaa cagtttcaaa 5100 |
| ataaaatatc atacaaatat tgagggaaat gttttcatat ttttcaaaat aggtttttat 5160 |
| tgttgaatgt acatctaccc cagcccctca aaagaaaaac tgtttacata gaaattccta 5220 |
| cacatacgtt tgcgtatatg ttattttaaa catctttgtg gtgagaattt tttccccgat 5280 |
| attctccttc tgtcaaagtc agaacaaatt cagggaattt attttctggc agttgtgctc 5340 |
| cagtcctttt aaaattgtac atgaacatgt tttagaaaca atatggagga tgatgcatac 5400 |
| atgtcggtca agttcagcgc tcgacatttt atggaaagat ttttttaacc ttaccacgaa 5460 |
| atacttaact actgtttaag tgaattgact tatttcactt tagtttttga actgtgatta 5520 |
| ttggtatact gttatatcct caacttggat ttatggtaac cccttttagt tcatggagac 5580 |
| caaaatttgg ggtatttata atagtcagcg caggaatgca catggaatat ctacttgtcc 5640 |
| ttttgaacct cacgagtcat ccagaatgta tagacaggaa aagcatgtct tatttaaaac 5700 |
| tgtaatttat gggctcagga tctgaccgca gtcccgggag taagcatttc aaagggggaa 5760 |
| ggcagtgtgg tccctaccct gtgtgaatgt gaggatgtag acatccatca gtgcaactcg 5820 |
| agctccatcc tcctccgatt tctaaggctc cagttttctg gagggacagt catcatgttt 5880 |
| tgatttatct gggagaaaac tgtggtgcac agcttgtgag gagggcaagg ttgtgacgtt 5940 |
| cgagcttagt tctggtgtta ttctgtctcc tcttctttgt catcagccaa aacgtggttt 6000 |
| ttaaagagag tcatgcaggt tagaaataat gtcaaaaata tttaggaatt taataacctt 6060 |
| taagtcagaa actaaaacaa atactgaaat attagctctt cctacacttc gtgttcccct 6120 |
| ttagctgcct gaaaatcaag attgctccta ctcagatctt ctgagtggct aaaacttatg 6180 |
| gatatgaaaa atgagattga atgatgacta tgctttgcta tcattgttac ctttcctcaa 6240 |
| tactatttgg caactactgg gactcttcag cacaaaagga atagatctat gattgaccct 6300 |
| gattttaatt gtgaaattat atgattcata tattttatga atcagaataa ccttcaaata 6360 |
| aaataaatct aagtcggtta aaatggattt catgattttc cctcagaaaa tgagtaacgg 6420 |
| agtccacggc gtgcaatggt aattataaat tggtgatgct tgtttgcaaa ttgcccactc 6480 |
| gtgataagtc aacagccaat atttaaaact ttgttcgtta ctggctttac cctaactttc 6540 |
| tctagtctac tgtcaatatc attttaatgt aattgattgt atatagtctc aagaatggtt 6600 |
| ggtgggcatg agttcctaga gaactgtcca agggttggga aaatccaaat tctcttcctg 6660 |
| gctccagcac tgattttgta cataaacatt aggcaggttg cttaaccttt ttatttcaaa 6720 |
| ctctctcaac tctaaagtgc taataataat ctcagttacc ttatctttgt cacagggtgt 6780 |
| tctttttat gaagaaaaat ttgaaaatga taaaagctaa gatgccttct aacttcataa 6840 |
| gcaaaccttt aactaattat gtatctgaaa gtcaccccca cataccaact caactttttt 6900 |
| cctgtgaaca cataaatata tttttataga aaaacaaatc tacataaaat aaatctactg 6960 |
| tttagtgagc agtatgactt gtacatgcca ttgaaaatta ttaatcagaa gaaaattaag 7020 |
| cagggtcttt gctatacaaa agtgttttcc actaattttg catgcgtatt tataagaaaa 7080 |
| atgtgaattt ggtggtttta ttctatcggt ataaaggcat cgatatttta gatgcacccg 7140 |
| tgtttgtaaa aatgtagagc acaatggaat tatgctggaa gtctcaaata atattttttt 7200 |
| cctattttat actcatggaa gagataagct aaagagggga caataatgag aaatgttggt 7260 |
| gtgcttttct aagcatttaa aacataattg ccaattgaaa ccctaaatat gtttacatac 7320 |
| cattaagata tgattcatgt aacaatgtta aattaattat aatgggattg ggtttgttat 7380 |

TABLE LIIf-continued

| Nucleotide sequence of transcript variant 282P1G03 v.7 |
|---|
| ctgtggtagt atatatccta gtgttcctat agtgaaataa gtagggttca gccaaagctt 7440 |
| tctttgtttt gtaccttaaa ttgttcgatt acgtcatcaa aagagatgaa aggtatgtag 7500 |
| aacaggttca cgtgattacc tttttctttt ggcttggatt aatattcata gtagaacttt 7560 |
| ataaaacgtg tttgtattgt aggtggtgtt tgtattatgc ttatgactat gtatggtttg 7620 |
| aaaatatttt cattatacat gaaattcaac tttccaaata aaagttctac ttcatgtaat 7680 |
| ccaaaa 7686 |

TABLE LIIIf

| Nucleotide sequence alignment of 282P1G03 v.1 (SEQ ID NO: 182) and 282P1G03 v.7 (SEQ ID NO: 183) | | | |
|---|---|---|---|
| v.1 | 1 | cggaccctgcgcgcccccgtcccggctcccggccggctcgggggagaagg | 50 |
| v.7 | 1 | CGGACCCTGCGCGCCCCCGTCCCGGCTCCCGGCCGGCTCGGGGGAGAAGG | 50 |
| v.1 | 51 | cgcccgaggggaggcgccggacagatcgcgtttcggaggcggcgcaggtg | 100 |
| v.7 | 51 | CGCCCGAGGGGAGGCGCCGGACAGATCGCGTTTCGGAGGCGGCGCAGGTG | 100 |
| v.1 | 101 | ctgtaaactgcaaaccataatcctgtcttaatactgcaaacaaatcatag | 150 |
| v.7 | 101 | CTGTAAACTGCAAACCATAATCCTGTCTTAATACTGCAAACAAATCATAG | 150 |
| v.1 | 151 | tggaactaaggggaacttaatttactgtttccaggttaactaaggtctca | 200 |
| v.7 | 151 | TGGAACTAAGGGGAACTTAATTTACTGTTTCCAGGTTAACTAAGGTCTCA | 200 |
| v.1 | 201 | gctgtaaaccaaaagtgagaggagacattaagattttcattcttaccggg | 250 |
| v.7 | 201 | GCTGTAAACCAAAAGTGAGAGGAGACATTAAGATTTTCATTCTTACCGGG | 250 |
| v.1 | 251 | ttgtcttcttcctgaagagcaatggagccgcttttacttggaagaggact | 300 |
| v.7 | 251 | TTGTCTTCTTCCTGAAGAGCAATGGAGCCGCTTTTACTTGGAAGAGGACT | 300 |
| v.1 | 301 | aatcgtatatctaatgttcctcctgttaaaattctcaaaagcaattgaaa | 350 |
| v.7 | 301 | AATCGTATATCTAATGTTCCTCCTGTTAAAATTCTCAAAAGCAATTGAAA | 350 |
| v.1 | 351 | taccatcttcagttcaacaggttccaacaatcataaaacagtcaaaagtc | 400 |
| v.7 | 351 | TACCATCTTCAGTTCAACAGGTTCCAACAATCATAAAACAGTCAAAAGTC | 400 |
| v.1 | 401 | caagttgcctttcccttcgatgagtattttcaaattgaatgtgaagctaa | 450 |
| v.7 | 401 | CAAGTTGCCTTTCCCTTCGATGAGTATTTTCAAATTGAATGTGAAGCTAA | 450 |
| v.1 | 451 | aggaaatccagaaccaacattttcgtggactaaggatggcaaccctttttt | 500 |
| v.7 | 451 | AGGAATCCAGAACCAACATTTTCGTGGACTAAGGATGGCAACCCTTTTT | 500 |
| v.1 | 501 | atttcactgaccatcggataattccatcgaacaattcaggaacattcagg | 550 |
| v.7 | 501 | ATTTCACTGACCATCGGATAATTCCATCGAACAATTCAGGAACATTCAGG | 550 |
| v.1 | 551 | atcccaaacgaggggcacatatctcactttcaagggaaataccgctgctt | 600 |
| v.7 | 551 | ATCCCAAACGAGGGGCACATATCTCACTTTCAAGGGAAATACCGCTGCTT | 600 |
| v.1 | 601 | tgcttcaaataaactgggaatcgctatgtcagaagaaatagaatttatag | 650 |
| v.7 | 601 | TGCTTCAAATAAACTGGGAATCGCTATGTCAGAAGAAATAGAATTTATAG | 650 |
| v.1 | 651 | ttccaagtgttccaaaactcccaaaagaaaaaattgaccctcttgaagtg | 700 |
| v.7 | 651 | TTCCAAGTGTTCCAAAACTCCCAAAAGAAAAAATTGACCCTCTTGAAGTG | 700 |

TABLE LIIIf-continued

Nucleotide sequence alignment of 282P1G03 v.1 (SEQ ID NO: 182) and 282P1G03 v.7 (SEQ ID NO: 183)

```
v.1   701  gaggagggagatccaattgtcctcccatgcaatcctcccaaaggcctccc  750
           ||||||||||||||||||||||||||||||||||||||||||||||||||
v.7   701  GAGGAGGGAGATCCAATTGTCCTCCCATGCAATCCTCCCAPAGGCCTCCC  750

v.1   751  acctttacacatttattggatgaatattgaattagaacacatcgaacaag  800
           ||||||||||||||||||||||||||||||||||||||||||||||||||
v.7   751  ACCTTTACACATTTATTGGATGAATATTGAATTAGAACACATCGAACAAG  800

v.1   801  atgaaagagtatacatgagccaaaagggagatctatacttcgcaaacgtg  850
           ||||||||||||||||||||||||||||||||||||||||||||||||||
v.7   801  ATGAAAGAGTATACATGAGCCAAAAGGGACATCTATACTTCGCAAACGTG  850

v.1   851  gaagaaaaggacagtcgcaatgactactgttgctttgctgcatttccaag  900
           ||||||||||||||||||||||||||||||||||||||||||||||||||
v.7   851  GAAGAAAAGGACAGTCGCAATGACTACTGTTGCTTTGCTGCATTTCCAAG  900

v.1   901  attaaggactattgtacagaaaatgccaatgaaactaacagttaacagtt  950
           ||||||||||||||||||||||||||||||||||||||||||||||||||
v.7   901  ATTAAGGACTATTGTACAGAAAATGCCAATGAAACTAACAGTTAACAGTT  950

v.1   951  taaagcatgctaatgactcaagttcatccacagaaattggttccaaggca  1000
           ||||||||||||||||||||||||||||||||||||||||||||||||||
v.7   951  TAAAGCATGCTAATGACTCAAGTTCATCCACAGAAATTGGTTCCAAGGCA  1000

v.1  1001  aattccatcaagcaaagaaaacccaaactgctgttgcctcccactgagag  1050
           ||||||||||||||||||||||||||||||||||||||||||||||||||
v.7  1001  AATTCCATCAAGCAAAGAAAACCCAAACTGCTGTTGCCTCCCACTGAGAG  1050

v.1  1051  tggcagtgagtcttcaattaccatcctcaaaggggaaatcttgctgcttg  1100
           ||||||||||||||||||||||||||||||||||||||||||||||||||
v.7  1051  TGGCAGTGAGTCTTCAATTACCATCCTCAAAGGGGAAATCTTGCTGCTTG  1100

v.1  1101  agtgttttgctgaaggcttgccaactccacaggttgattggaacaaaatt  1150
           ||||||||||||||||||||||||||||||||||||||||||||||||||
v.7  1101  AGTGTTTTGCTGAAGGCTTGCCAACTCCACAGGTTGATTGGAACAAAATT  1150

v.1  1151  ggtggtgacttaccaaaggggagagaaacaaaagaaaattlatggcaagac 1200
           ||||||||||||||||||||||||||||||||||||||||||||||||||
v.7  1151  GGTGGTGACTTACCAAAGGGGAGAGAPACAAAAGAAAATTATGGCAAGAC  1200

v.1  1201  tttgaagatagagaatgtctcctaccaggacaaaggaaattatcgctgca  1250
           ||||||||||||||||||||||||||||||||||||||||||||||||||
v.7  1201  TTTGAAGATAGAGAATGTCTCCTACCAGGACAAAGGAAATTATCGCTGCA  1250

v.1  1251  cagccagcaatttcttgggaacagccactcacgattttcacgttatagta  1300
           ||||||||||||||||||||||||||||||||||||||||||||||||||
v.7  1251  CAGCCAGCAATTTCTTGGGAACAGCCACTCACGATTTTCACGTTATAGTA  1300

v.1  1301  ga------------------------------------agagcctcctcg  1314
           ||                                    ||||||||||||
v.7  1301  GAAGataacatctctcatgagctcttcactttacatccagAGCCTCCTCG  1350

v.1  1315  ctggacaaagaagcctcagagtgctgtgtatagcaccggaagcaatggca  1364
           ||||||||||||||||||||||||||||||||||||||||||||||||||
v.7  1351  CTGGACAAAGAAGCCTCAGAGTGCTGTGTATAGCACCGGAAGCAATGGCA  1400

v.1  1365  tcttgttatgtgaggctgaaggagaacctcaacccacaatcaagtggaga  1414
           ||||||||||||||||||||||||||||||||||||||||||||||||||
v.7  1401  TCTTGTTATGTGAGGCTGAAGGAGAACCTCAACCCACAATCAAGTGGAGA  1450

v.1  1415  gtcaatggctccccagttgacaatcatccatttgctggtgatgttgtctt  1464
           ||||||||||||||||||||||||||||||||||||||||||||||||||
v.7  1451  GTCAATGGCTCCCCAGTTGACAATCATCCATTTGCTGGTGATGTTGTCTT  1500

v.1  1465  ccccagggaaatcagttttaccaaccttcaaccaaatcatactgctgtgt  1514
           ||||||||||||||||||||||||||||||||||||||||||||||||||
v.7  1501  CCCCAGGGAAATCAGTTTTACCAACCTTCAACCAAATCATACTGCTGTGT  1550

v.1  1515  accagtgtgaagcctcaaatgtccatggaactatccttgccaatgccaat  1564
           ||||||||||||||||||||||||||||||||||||||||||||||||||
v.7  1551  ACCAGTGTGAAGCCTCAAATGTCCATGGAACTATCCTTGCCAATGCCAAT  1600

v.1  1565  attgatgttgtggatgtccgtccattgatacaaaccaaagatggagaaaa  1614
           ||||||||||||||||||||||||||||||||||||||||||||||||||
v.7  1601  ATTGATGTTGTCGATGTCCGTCCATTGATACAAACCAAAGATGGAGAAAA  1650
```

TABLE LIIIf-continued

Nucleotide sequence alignment of 282P1G03 v.1 (SEQ ID NO: 182) and 282P1G03 v.7 (SEQ ID NO: 183)

```
v.1  1615  ttacgctacagtggttgggtacagtgctttcttacattgcgagttctttg  1664
           ||||||||||||||||||||||||||||||||||||||||||||||||||
v.7  1651  TTACGCTACAGTGGTTGGGTACAGTGCTTTCTTACATTGCGAGTTCTTTG  1700

v.1  1665  cttcacctgaggcagtcgtgtcctggcagaaggtggaagaagtgaaaccc  1714
           ||||||||||||||||||||||||||||||||||||||||||||||||||
v.7  1701  CTTCACCTGAGGCAGTCGTGTCCTGGCAGAAGGTGGAAGAAGTGAAACCC  1750

v.1  1715  ctggagggcaggcggtatcatatctatgaaaatggcacattgcagatcaa  1764
           ||||||||||||||||||||||||||||||||||||||||||||||||||
v.7  1751  CTGGAGGGCAGGCGGTATCATATCTATGAAAATGGCACATTGCAGATCAA  1800

v.1  1765  cagaaccaccgaagaagatgctgggtcttactcatgttgggtagaaaatg  1814
           ||||||||||||||||||||||||||||||||||||||||||||||||||
v.7  1801  CAGAACCACCGAAGAAGATGCTGGGTCTTACTCATGTTGGGTAGAAAATG  1850

v.1  1815  ctataggaaaaactgcagtcacagccaatttggatattagaaatgctaca  1864
           ||||||||||||||||||||||||||||||||||||||||||||||||||
v.7  1851  CTATAGGAAAAACTGCAGTCACAGCCAATTTGGATATTAGAAATGCTACA  1900

v.1  1865  aaacttagagtttctcctaagaatcctcgtatccccaaattgcatatgct  1914
           ||||||||||||||||||||||||||||||||||||||||||||||||||
v.7  1901  AAACTTAGAGTTTCTCCTAAGAATCCTCGTATCCCCAAATTGCATATGCT  1950

v.1  1915  tgaattacattgtgaaagcaaatgtgactcacatttgaaacacagtttga  1964
           ||||||||||||||||||||||||||||||||||||||||||||||||||
v.7  1951  TGAATTACATTGTGAAAGCAAATGTGACTCACATTTGAAACACAGTTTGA  2000

v.1  1965  agttgtcctggagtaaagatggagaagcctttgaaattaatggcacagaa  2014
           ||||||||||||||||||||||||||||||||||||||||||||||||||
v.7  2001  AGTTGTCCTGGAGTAAAGATGGAGAAGCCTTTGAAATTAATGGCACAGAA  2050

v.1  2015  gatggcaggataattattgatggagctaatttgaccatatctaatgtaac  2064
           ||||||||||||||||||||||||||||||||||||||||||||||||||
v.7  2051  GATGGCAGGATAATTATTGATGGAGCTAATTTGACCATATCTAATGTAAC  2100

v.1  2065  tttagaggaccaaggtatttactgctgttcagctcatactgctctagaca  2114
           ||||||||||||||||||||||||||||||||||||||||||||||||||
v.7  2101  TTTAGAGGACCAAGGTATTTACTGCTGTTCAGCTCATACTGCTCTAGACA  2150

v.1  2115  gtgctgccgatataactcaagtaactgttcttgatgttccggatccacca  2164
           ||||||||||||||||||||||||||||||||||||||||||||||||||
v.7  2151  GTGCTGCCGATATAACTCAAGTAACTGTTCTTGATGTTCCGGATCCACCA  2200

v.1  2165  gaaaaccttcacttgtctgaaagacagaacaggagtgttcggctgacctg  2214
           ||||||||||||||||||||||||||||||||||||||||||||||||||
v.7  2201  GAAAACCTTCACTTGTCTGAAAGACAGAACAGGAGTGTTCGGCTGACCTG  2250

v.1  2215  ggaagctggagctgaccacaacagcaatattagcgagtatattgttgaat  2264
           ||||||||||||||||||||||||||||||||||||||||||||||||||
v.7  2251  GGAAGCTGGAGCTGACCACAACAGCAATATTAGCGAGTATATTGTTGAAT  2300

v.1  2265  ttgaaggaaacaaagaagagcctggaaggtgggaggaactgaccagagtc  2314
           ||||||||||||||||||||||||||||||||||||||||||||||||||
v.7  2301  TTGAAGGAAACAAAGAAOAGCCTGGAAGGTGGGAGGAACTGACCAGAGTC  2350

v.1  2315  caaggaaagaaaaccacagttatcttacctttggctccatttgtgagata  2364
           ||||||||||||||||||||||||||||||||||||||||||||||||||
v.7  2351  CAAGGAAAGAAAACCACAGTTATCTTACCTTTGGCTCCATTTGTGAGATA  2400

v.1  2365  ccagttcagggtcatagccgtgaacgaagtagggagaagtcagcctagcc  2414
           ||||||||||||||||||||||||||||||||||||||||||||||||||
v.7  2401  CCAGTTCAGGGTCATAGCCGTGAACGAAGTAGGGAGAAGTCAGCCTAGCC  2450

v.1  2415  agccgtcagaccatcatigaaacaccaccagcagctccagataggaatcca 2464
           ||||||||||||||||||||||||||||||||||||||||||||||||||
v.7  2451  AGCCGTCAGACCATCATGAAACACCACCAGCAGCTCCAGATAGGAATCCA  2500

v.1  2465  caaaacataagggttcaagcctctcaacccaaggaaatgattataaagtg  2514
           ||||||||||||||||||||||||||||||||||||||||||||||||||
v.7  2501  CAAAACATAAGGGTTCAAGCCTCTCAACCCAAGGAAATGATTATAAAGTG  2550

v.1  2515  ggagcctttgaaatccatggagcagaatggaccaggcctagagtacagag  2564
           ||||||||||||||||||||||||||||||||||||||||||||||||||
v.7  2551  GGAGCCTTTGAAATCCATGCAGCAGAATGGACCAGGCCTAGAGTACAGAG  2600
```

TABLE LIIIf-continued

Nucleotide sequence alignment of 282P1G03 v.1 (SEQ ID NO: 182) and 282P1G03 v.7 (SEQ ID NO: 183)

```
v.1  2565  tgacctggaagccacagggagccccagtggagtgggaagaagaaacagtc  2614
           ||||||||||||||||||||||||||||||||||||||||||||||||||
v.7  2601  TGACCTGGAAGCCACAGGGAGCCCCAGTGGAGTGGGAAGAAGAAACAGTC  2650

v.1  2615  acaaaccacacattgcgggtgatgacgcctgctgtctatgccccttatga  2664
           ||||||||||||||||||||||||||||||||||||||||||||||||||
v.7  2651  ACAAACCACACATTGCGGGTGATGACGCCTGCTGTCTATGCCCCTTATGA  2700

v.1  2665  tgtcaaggtccaggctatcaatcaactaggatctgggcctgaccctcagt  2714
           ||||||||||||||||||||||||||||||||||||||||||||||||||
v.7  2701  TGTCAAGGTCCAGGCTATCAATCAACTAGGATCTGGGCCTGACCCTCAGT  2750

v.1  2715  cagtgactctctattctggagaagactatcctgatacagctccagtgatc  2764
           ||||||||||||||||||||||||||||||||||||||||||||||||||
v.7  2751  CAGTGACTCTCTATTCTGGAGAAGACTATCCTGATACAGCTCCAGTGATC  2800

v.1  2765  catggggtggacgttataaacagtacattagttaaagttacctggtcaac  2814
           ||||||||||||||||||||||||||||||||||||||||||||||||||
v.7  2801  CATGGGGTGGACGTTATAAACAGTACATTAGTTAAAGTTACCTGGTCAAC  2850

v.1  2815  agttccaaaggacagagtacatggacgtctgaaaggctatcagataaatt  2864
           ||||||||||||||||||||||||||||||||||||||||||||||||||
v.7  2851  AGTTCCAAAGGACAGAGTACATGGACGTCTGAAAGGCTATCAGATAAATT  2900

v.1  2865  ggtggaaaacaaaaagtctgttggatggaagaacacatcccaaagaagtg  2914
           ||||||||||||||||||||||||||||||||||||||||||||||||||
v.7  2901  GGTGGAAAACAAAAAGTCTGTTGGATGGAAGAACACATCCCAAAGAAGTG  2950

v.1  2915  aacattctaagattttcaggacaaagaaactctggaatggttccttcctt  2964
           ||||||||||||||||||||||||||||||||||||||||||||||||||
v.7  2951  AACATTCTAAGATTTTCAGGACAAAGAAACTCTQGAATGGTTCCTTCCTT  3000

v.1  2965  agatgcctttagtgaatttcatttaacagtcttagcctataactctaaag  3014
           ||||||||||||||||||||||||||||||||||||||||||||||||||
v.7  3001  AGATGCCTTTAGTGAATTTCATTTAACAGTCTTAGCCTATAACTCTAAAG  3050

v.1  3015  gagctggtcctgaaagtgagccttatatatttcaaacaccagaaggagta  3064
           ||||||||||||||||||||||||||||||||||||||||||||||||||
v.7  3051  GAGCTGGTCCTGAAAGTGAGCCTTATATATTTCAAACACCAGAAGGAGTA  3100

v.1  3065  cctgaacagccaacttttctaaaggtcatcaaagttgataaagacactgc  3114
           ||||||||||||||||||||||||||||||||||||||||||||||||||
v.7  3101  CCTGAACAGCCAACTTTTCTAAAGGTCATCAAAGTTGATAAAGACACTGC  3150

v.1  3115  cactttatcttggggactacctaagaaattaaatggaaacttaactggct  3164
           ||||||||||||||||||||||||||||||||||||||||||||||||||
v.7  3151  CACTTTATCTTGGGGACTACCTAAGAAATTAAATGGAAACTTAACTGGCT  3200

v.1  3165  atcttttgcaatatcagataataaatgacacctacgagattggagaatta  3214
           ||||||||||||||||||||||||||||||||||||||||||||||||||
v.7  3201  ATCTTTTGCAATATCAGATAATAAATGACACCTACGAGATTGGAGAATTA  3250

v.1  3215  aatgatattaacattacaactccatcaaagcccagctggcacctctcaaa  3264
           ||||||||||||||||||||||||||||||||||||||||||||||||||
v.7  3251  AATGATATTAACATTACAACTCCATCAAAGCCCAGCTGGCACCTCTCAAA  3300

v.1  3265  cctgaatgcaactaccaagtacaaattctacttgagggcttgcacttcac  3314
           ||||||||||||||||||||||||||||||||||||||||||||||||||
v.7  3301  CCTGAATGCAACTACCAAGTACAAATTCTACTTGAGGGCTTGCACTTCAC  3350

v.1  3315  agggctgtggaaaaccgatcacggaggaaagctccaccttaggagaaggg  3364
           ||||||||||||||||||||||||||||||||||||||||||||||||||
v.7  3351  AGGGCTGTGGAAAACCGATCACGGAGGAAAGCTCCACCTTAGGAGAAGGG  3400

v.1  3365  agtaaaggtatcgggaagatatcaggagtaaatcttactcaaaagactca  3414
           ||||||||||||||||||||||||||||||||||||||||||||||||||
v.7  3401  AGTAAAGGTATCGGGAAGATATCAGGAGTAAATCTTACTCAAAAGACTCA  3450

v.1  3415  cccaatagaggtatttgagccgggagctgaacatatagttcgcctaatga  3464
           ||||||||||||||||||||||||||||||||||||||||||||||||||
v.7  3451  CCCAATAGAGGTATTTGAGCCGGGAGCTGAACATATAGTTCGCCTAATGA  3500

v.1  3465  ctaagaattggggcgataacgatagcatttttcaagatgtaattgagaca  3514
           ||||||||||||||||||||||||||||||||||||||||||||||||||
v.7  3501  CTAAGAATTGGGGCGATAACGATAGCATTTTTCAAGATGTAATTGAGACA  3550
```

TABLE LIIIf-continued

Nucleotide sequence alignment of 282P1G03 v.1 (SEQ ID NO: 182) and 282P1G03 v.7 (SEQ ID NO: 183)

```
v.1  3515  agagggagagaatatgctggtttatatgatgacatctccactcaaggctg  3564
           ||||||||||||||||||||||||||||||||||||||||||||||||||
v.7  3551  AGAGGGAGAGAATATGCTGGTTTATATGATGACATCTCCACTCAAGGCTG  3600

v.1  3565  gtttattggactgatgtgtgcgattgctcttctcacactactattattaa  3614
           ||||||||||||||||||||||||||||||||||||||||||||||||||
v.7  3601  GTTTATTGGACTGATGTGTGCGATTGCTCTTCTCACACTACTATTATTAA  3650

v.1  3615  ctgtttgctttgtgaagaggaatagaggtggaaagtactcagttaaagaa  3664
           ||||||||||||||||||||||||||||||||||||||||||||||||||
v.7  3651  CTGTTTGCTTTGTGAAGAGGAATAGAGGTGGAAAGTACTCAGTTAAAGAA  3700

v.1  3665  aaggaagatttgcatccagacccagaaattcagtcagtaaaagatgaaac  3714
           ||||||||||||||||||||||||||||||||||||||||||||||||||
v.7  3701  AAGGAAGATTTGCATCCAGACCCAGAAATTCAGTCAGTAAAAGATGAAAC  3750

v.1  3715  ctttggtgaatacagtgacagtgatgaaaagcctctcaaaggaagccttc  3764
           ||||||||||||||||||||||||||||||||||||||||||||||||||
v.7  3751  CTTTGGTGAATACAGTGACAGTGATGAAAAGCCTCTCAAAGGAAGCCTTC  3800

v.1  3765  ggtcccttaatagggatatgcagcctactgaaagtgctgacagcttagtc  3814
           ||||||||||||||||||||||||||||||||||||||||||||||||||
v.7  3801  GGTCCCTTAATAGGGATATGCAGCCTACTGAAAGTGCTGACAGCTTAGTC  3850

v.1  3815  gaatacggagagggagaccatggtctcttcagtgaagatggatcatttat  3864
           ||||||||||||||||||||||||||||||||||||||||||||||||||
v.7  3851  GAATACGGAGAGGGAGACCATGGTCTCTTCAGTGAAGATGGATCATTTAT  3900

v.1  3865  tggtgcctacgctggatctaaggagaagggatctgttgaaagcaatggaa  3914
           ||||||||||||||||||||||||||||||||||||||||||||||||||
v.7  3901  TGGTGCCTACGCTGGATCTAAGGAGAAGGGATCTGTTGAAAGCAATGGAA  3950

v.1  3915  gttctacagcaacttttccccttcgggcataaacacaacatatgtaagca  3964
           ||||||||||||||||||||||||||||||||||||||||||||||||||
v.7  3951  GTTCTACAGCAACTTTTCCCCTTCGGGCATAAACACAACATATGTAAGCA  4000

v.1  3965  acgctactggttcaccccaaccttccatatttatctgttcaaaggagcaa  4014
           ||||||||||||||||||||||||||||||||||||||||||||||||||
v.7  4001  ACGCTACTGGTTCACCCCAACCTTCCATATTTATCTGTTCAAAGGAGCAA  4050

v.1  4015  gaactttcatataggaatagaaacatgctggccgaagatttcatccagaa  4064
           ||||||||||||||||||||||||||||||||||||||||||||||||||
v.7  4051  GAACTTTCATATAGGAATAGAAACATGCTGGCCGAAGATTTCATCCAGAA  4100

v.1  4065  gtcaacatcctgcaattatgttgaaaagagtagtactttcttcaaaatat  4114
           ||||||||||||||||||||||||||||||||||||||||||||||||||
v.7  4101  GTCAACATCCTGCAATTATGTTGAAAAGAGTAGTACTTTCTTCAAAATAT  4150

v.1  4115  aaaatgccaagcacttcaggcctatgttttgcttatattgttttcaggtg  4164
           ||||||||||||||||||||||||||||||||||||||||||||||||||
v.7  4151  AAAATGCCAAGCACTTCAGGCCTATGTTTTGCTTATATTGTTTTCAGGTG  4200

v.1  4165  ctcaaaatgcaaaacacaaaacaaatcctgcatttagatacacctcaact  4214
           ||||||||||||||||||||||||||||||||||||||||||||||||||
v.7  4201  CTCAAAATGCAAAACACAAAACAAATCCTGCATTTAGATACACCTCAACT  4250

v.1  4215  aaatccaaagtccccattcagtatattccatatttgcctgattttactat  4264
           ||||||||||||||||||||||||||||||||||||||||||||||||||
v.7  4251  AAATCCAAAGTCCCCATTCAGTATATTCCATATTTGCCTGATTTTACTAT  4300

v.1  4265  tcggtgtgtttgcatagatgttgctacttggtgggtttttctccgtatgc  4314
           ||||||||||||||||||||||||||||||||||||||||||||||||||
v.7  4301  TCGGTGTGTTTGCATAGATGTTGCTACTTGGTGGGTTTTTCTCCGTATGC  4350

v.1  4315  acattggtatacagtctctgagaactggcttggtgactttgcttcactac  4364
           ||||||||||||||||||||||||||||||||||||||||||||||||||
v.7  4351  ACATTGGTATACAGTCTCTGAGAACTGGCTTGGTGACTTTGCTTCACTAC  4400

v.1  4365  aggttaaaagaccataagcaaactggttatttaaaatgtaaaaaggaata  4414
           ||||||||||||||||||||||||||||||||||||||||||||||||||
v.7  4401  AGGTTAAAAGACCATAAGCAAACTGGTTATTTAAAATGTAAAAAGGAATA  4450

v.1  4415  tgaaagtcttattaaaacacttcattgaaaatatacagtctaaatttatt  4464
           ||||||||||||||||||||||||||||||||||||||||||||||||||
v.7  4451  TGAAAGTCTTATTAAAACACTTCATTGAAAATATACAGTCTAAATTTATT  4500
```

TABLE LIIIf-continued

Nucleotide sequence alignment of 282P1G03 v.1 (SEQ ID NO: 182) and 282P1G03 v.7 (SEQ ID NO: 183)

```
v.1  4465  atttaaattttactagcaaaagtcttaggtgaacaatcaactagtatttg  4514
           ||||||||||||||||||||||||||||||||||||||||||||||||||
v.7  4501  ATTTAAATTTTACTAGCAAAAGTCTTAGGTGAACAATCAACTAGTATTTG  4550

v.1  4515  ttgagctcctatttgcccagagatggtcatatttaaacagaagtatacgt  4564
           ||||||||||||||||||||||||||||||||||||||||||||||||||
v.7  4551  TTGAGCTCCTATTTGCCCAGAGATGGTCATATTTAAACAGAAGTATACGT  4600

v.1  4565  ttttcagtttcaacatgaatttttttatttctgtcagttatgacatccac  4614
           ||||||||||||||||||||||||||||||||||||||||||||||||||
v.7  4601  TTTTCAGTTTCAACATGAATTTTTTTATTTCTGTCAGTTATGACATCCAC  4650

v.1  4615  gagcatcactttttgtgtctgttttttttttttttcttggactaaattcaa  4664
           ||||||||||||||||||||||||||||||||||||||||||||||||||
v.7  4651  gAGCATCACTTTTTGTGTCTGTTTTTTTTTTTTTTCTTGGACTAAATTCAA  4700

v.1  4665  ctgcatggaagcggtggtcagaaggttgttttatacgagaacaggcagaa  4714
           ||||||||||||||||||||||||||||||||||||||||||||||||||
v.7  4701  CTGCATGGAAGCGGTGGTCAGAAGGTTGTTTTATACGAGAACAGGCAGAA  4750

v.1  4715  agtgcccattgttcaggattctaatagctacatctacttaatatcttcat  4764
           ||||||||||||||||||||||||||||||||||||||||||||||||||
v.7  4751  AGTGCCCATTGTTCAGGATTCTAATAGCTACATCTACTTAATATCTTCAT  4800

v.1  4765  ttctaaattgactgcttttaccttttttctcatgtttatataatggtatgc  4814
           ||||||||||||||||||||||||||||||||||||||||||||||||||
v.7  4801  TTCTAAATTGACTGCTTTTACCTTTTTCTCATGTTTATATAATGGTATGC  4850

v.1  4815  ttgcatatatttcatgaatacattgtacatattatgttaatatttacaca  4864
           ||||||||||||||||||||||||||||||||||||||||||||||||||
v.7  4851  TTGCATATATTTCATGAATACATTGTACATATTATGTTAATATTTACACA  4900

v.1  4865  atttaaaatatagatgtgttttattttgaagtgagaaaatgaacattaac  4914
           ||||||||||||||||||||||||||||||||||||||||||||||||||
v.7  4901  ATTTAAAATATAGATGTGTTTTATTTTGAAGTGAGAAAATGAACATTAAC  4950

v.1  4915  aggcatgtttgtacagctagaatatattagtaagatactgtttttcgtca  4964
           ||||||||||||||||||||||||||||||||||||||||||||||||||
v.7  4951  AGGCATGTTTGTACAGCTAGAATATATTAGTAAGATACTGTTTTTCGTCA  5000

v.1  4965  ttccagagctacaactaataacacgaggttccaaagctgaagactttgta  5014
           ||||||||||||||||||||||||||||||||||||||||||||||||||
v.7  5001  TTCCAGAGCTACAACTAATAACACGAGGTTCCAAAGCTGAAGACTTTGTA  5050

v.1  5015  taaagtatttgggttttgttcttgtattgctttctttcaacagtttcaaa  5064
           ||||||||||||||||||||||||||||||||||||||||||||||||||
v.7  5051  TAAAGTATTTGGGTTTTGTTCTTGTATTGCTTTCTTTCAACAGTTTCAAA  5100

v.1  5065  ataaaatatcatacaaatattgagggaaatgttttcatatttttcaaaat  5114
           ||||||||||||||||||||||||||||||||||||||||||||||||||
v.7  5101  ATAAAATATCATAcAAATATTGAGGGAAATGTTTTCATATTTTTCAAAAT  5150

v.1  5115  aggtttttattgttgaatgtacatctaccccagcccctcaaaagaaaaac  5164
           ||||||||||||||||||||||||||||||||||||||||||||||||||
v.7  5151  AGGTTTTTATTGTTGAATGTACATCTACCCCAGCCCCTCAAAAGAAAAAC  5200

v.1  5165  tgtttacatagaaattcctacacatacgtttgcgtatatgttattttaaa  5214
           ||||||||||||||||||||||||||||||||||||||||||||||||||
v.7  5201  TGTTTACATAGAAATTCCTACACATACGTTTGCGTATATGTTATTTTAAA  5250

v.1  5215  catctttgtggtgagaatttttttccccgatattctccttctgtcaaagtc  5264
           ||||||||||||||||||||||||||||||||||||||||||||||||||
v.7  5251  CATCTTTGTGGTGAGAATTTTTTCCCCGATATTCTCCTTCTGTCAAAGTC  5300

v.1  5265  agaacaaattcagggaatttattttctggcagttgtgctccagtcctttt  5314
           ||||||||||||||||||||||||||||||||||||||||||||||||||
v.7  5301  AGAACAAATTCAGGGAATTTATTTTCTGGCAGTTGTGCTCCAGTCCTTTT  5350

v.1  5315  aaaattgtacatgaacatgttttagaaacaatatggaggatgatgcatac  5364
           ||||||||||||||||||||||||||||||||||||||||||||||||||
v.7  5351  AAAATTGTACATGAACATGTTTTAGAAACAATATGGAGGATGATGCATAC  5400

v.1  5365  atgtcggtcaagttcagcgctcgacattttatggaaagattttttttaacc  5414
           ||||||||||||||||||||||||||||||||||||||||||||||||||
v.7  5401  ATGTCGGTCAAGTTCAGCGCTCGACATTTTATGGAAAGATTTTTTTAACC  5450
```

TABLE LIIIf-continued

Nucleotide sequence alignment of 282P1G03 v.1 (SEQ ID NO: 182) and 282P1G03 v.7 (SEQ ID NO: 183)

```
v.1  5415  ttaccacgaaatacttaactactgtttaagtgaattgacttatttcactt  5464
           ||||||||||||||||||||||||||||||||||||||||||||||||||
v.7  5451  TTACCACGAAATACTTAACTACTGTTTAAGTGAATTGACTTATTTCACTT  5500

v.1  5465  tagtttttgaactgtgattattggtatactgttatatcctcaacttggat  5514
           ||||||||||||||||||||||||||||||||||||||||||||||||||
v.7  5501  TAGTTTTTGAACTGTGATTATTGGTATACTGTTATATCCTCAACTTGGAT  5550

v.1  5515  ttatggtaaccccttttagttcatggagaccaaaatttggggtatttata  5564
           ||||||||||||||||||||||||||||||||||||||||||||||||||
v.7  5551  TTATGGTAACCCCTTtTAGTTCATGGAGACCAAAATTTGGGGTATTTATA  5600

v.1  5565  atagtcagcgcaggaatgcacatggaatatctacttgtccttttgaacct  5614
           ||||||||||||||||||||||||||||||||||||||||||||||||||
v.7  5601  ATAGTCAGCGCAGGAATGCACATGGAATATCTACTTGTCCTTTTGAACCT  5650

v.1  5615  cacgagtcatccagaatgtatagacaggaaaagcatgtcttatttaaaac  5664
           ||||||||||||||||||||||||||||||||||||||||||||||||||
v.7  5651  CACGAGTCATCCAGAATGTATAGACAGGAAAAGCATGTCTTATTTAAAAC  5700

v.1  5665  tgtaatttatgggctcaggatctgaccgcagtcccgggagtaagcatttc  5714
           ||||||||||||||||||||||||||||||||||||||||||||||||||
v.7  5701  TGTAATTTATGGGCTCAGGATCTGACCGCAGTCCCGGGAGTAAGCATTTC  5750

v.1  5715  aaaggggggaaggcagtgtggtccctaccctgtgtgaatgtgaggatgtag  5764
           ||||||||||||||||||||||||||||||||||||||||||||||||||
v.7  5751  AAAGGGGGAAGGCAGTGTGGTCCCTACCCTGTGTGAATGTGAGGATGTAG  5800

v.1  5765  acatccatcagtgcaactcgagctccatcctcctccgatttctaaggctc  5814
           ||||||||||||||||||||||||||||||||||||||||||||||||||
v.7  5801  ACATCCATCAGTGCAACTCGAGCTCCATCCTCCTCCGATTTCTAAGGCTC  5850

v.1  5815  cagttttctggagggacagtcatcatgttttgatttatctgggagaaaac  5864
           ||||||||||||||||||||||||||||||||||||||||||||||||||
v.7  5851  CAGTTTTCTGGAGGGACAGTCATCATGTTTTGATTTATCTGGGAGAAAAC  5900

v.1  5865  tgtggtgcacagcttgtgaggagggcaaggttgtgacgttcgagcttagt  5914
           ||||||||||||||||||||||||||||||||||||||||||||||||||
v.7  5901  TGTGGTGCACAGCTTGTGAGGAGGGCAAGGTTGTGACGTTCGAGCTTAGT  5950

v.1  5915  tctggtgttattctgtctcctcttctttgtcatcagccaaaacgtggttt  5964
           ||||||||||||||||||||||||||||||||||||||||||||||||||
v.7  5951  TCTGGTGTTATTCTGTCTCCTCTTCTTTGTCATCAGCCAAAaCGTGGTTT  6000

v.1  5965  ttaaagagagtcatgcaggttagaaataatgtcaaaaatatttaggaatt  6014
           ||||||||||||||||||||||||||||||||||||||||||||||||||
v.7  6001  TTAAAGAGAGTCATGCAGGTTAGAAATAATGTCAAAAATATTTAGGAATT  6050

v.1  6015  taataacctttaagtcagaaactaaaacaaatactgaaatattagctctt  6064
           ||||||||||||||||||||||||||||||||||||||||||||||||||
v.7  6051  TAATAACCTTTAAGTCAGAAACTAAAACAAATACTGAAATATTAGCTCTT  6100

v.1  6065  cctacacttcgtgttcccctttagctgcctgaaaatcaagattgctccta  6114
           ||||||||||||||||||||||||||||||||||||||||||||||||||
v.7  6101  CCTACACTTCGTGTTCCCCTTTAGCTGCCTGAAAATCAAGATTGCTCCTA  6150

v.1  6115  ctcagatcttctgagtggctaaaacttatggatatgaaaaatgagattga  6164
           ||||||||||||||||||||||||||||||||||||||||||||||||||
v.7  6151  CTCAGATCTTCTGAGTGGCTAAAACTTATGGATATGAAAAATGAGATTGA  6200

v.1  6165  atgatgactatgctttgctatcattgttacctttcctcaatactatttgg  6214
           ||||||||||||||||||||||||||||||||||||||||||||||||||
v.7  6201  ATGATGACTATGCTTTGCTATCATTGTTACCTTTCCTCAATACTATTTGG  6250

v.1  6215  caactactgggactcttcagcacaaaaggaatagatctatgattgaccct  6264
           ||||||||||||||||||||||||||||||||||||||||||||||||||
v.7  6251  CAACTACTGGGACTCTTCAGCACAAAAGGAATAGATCTATGATTGACCCT  6300

v.1  6265  gattttaattgtgaaattatatgattcatatattttatgaatcagaataa  6314
           ||||||||||||||||||||||||||||||||||||||||||||||||||
v.7  6301  GATTTTAATTGTGAAATTATATGATTCATATATTTTATGAATCAGAATAA  6350

v.1  6315  ccttcaaataaaataaatctaagtcggttaaaatggatttcatgattttc  6364
           ||||||||||||||||||||||||||||||||||||||||||||||||||
v.7  6351  CCTTCAAATAAAATAAATCTAAGTCGGTTAAAATGGATTTCATGATTTTC  6400
```

TABLE LIIIf-continued

Nucleotide sequence alignment of 282P1G03 v.1 (SEQ ID NO: 182) and 282P1G03 v.7 (SEQ ID NO: 183)

```
v.1  6365  cctcagaaaatgagtaacggagtccacggcgtgcaatggtaattataaat  6414
           ||||||||||||||||||||||||||||||||||||||||||||||||||
v.7  6401  CCTCAGAAAATGAGTAACgGAGTCCACGGCGTGCAATGGTAATTATAAAT  6450

v.1  6415  tggtgatgcttgtttgcaaattgcccactcgtgataagtcaacagccaat  6464
           ||||||||||||||||||||||||||||||||||||||||||||||||||
v.7  6451  TGGTGATGCTTGTTTGCAAATTGCCCACTCGTGATAAGTCAACAGCCAAT  6500

v.1  6465  atttaaaactttgttcgttactggctttaccctaactttctctagtctac  6514
           ||||||||||||||||||||||||||||||||||||||||||||||||||
v.7  6501  ATTTAAAACTTTGTTCGTTACTGGCTTTACCCTAACTTTCTCTAGTCTAC  6550

v.1  6515  tgtcaatatcattttaatgtaattgattgtatatagtctcaagaatggtt  6564
           ||||||||||||||||||||||||||||||||||||||||||||||||||
v.7  6551  TGTCAATATCATTTTAATGTAATTGATTGTATATAGTCTCAAGAATGGTT  6600

v.1  6565  ggtgggcatgagttcctagagaactgtccaagggttgggaaaatccaaat  6614
           ||||||||||||||||||||||||||||||||||||||||||||||||||
v.7  6601  GGTGGGCATGAGTTCCTAGAGAACTGTCCAAGGGTTGGGAAAATCCAAAT  6650

v.1  6615  tctcttcctggctccagcactgattttgtacataaacattaggcaggttg  6664
           ||||||||||||||||||||||||||||||||||||||||||||||||||
v.7  6651  TCTCTTCCTGGcTCCAGCACTGATTTTGTACATAAACATTAGGCAGGTTG  6700

v.1  6665  cttaaccttttatttcaaactctctcaactctaaagtgctaataataat  6714
           ||||||||||||||||||||||||||||||||||||||||||||||||||
v.7  6701  CTTAACCTTTTTATTTCAAACTCTCTCAACTCTAAAGTGCTAATAATAAT  6750

v.1  6715  ctcagttaccttatctttgtcacagggtgttctttttttatgaagaaaaat  6764
           ||||||||||||||||||||||||||||||||||||||||||||||||||
v.7  6751  CTCAGTTACCTTATCTTTGTCACAGGGTGTTCTTTTTTATGAAGAAAAAT  6800

v.1  6765  ttgaaaatgataaaagctaagatgccttctaacttcataagcaaaccttt  6814
           ||||||||||||||||||||||||||||||||||||||||||||||||||
v.7  6801  TTGAAAATGATAAAAGCTAAGATGCCTTCTAACTTCATAAGCAAACCTTT  6850

v.1  6815  aactaattatgtatctgaaagtcacccccacataccaactcaactttttt  6864
           ||||||||||||||||||||||||||||||||||||||||||||||||||
v.7  6851  AACTAATTATGTATCTGAAAGTCACCCCCACATACCAACTCAACTTTTTT  6900

v.1  6865  cctgtgaacacataaatatatttttatagaaaaacaaatctacataaaat  6914
           ||||||||||||||||||||||||||||||||||||||||||||||||||
v.7  6901  CCTGTGAACACATAAATATATTTTTATAGAAAAACAAATCTACATAAAAT  6950

v.1  6915  aaatctactgtttagtgagcagtatgacttgtacatgccattgaaaatta  6964
           ||||||||||||||||||||||||||||||||||||||||||||||||||
v.7  6951  AAATCTACTGTTTAGTGAGCAGTATGAcTTGTACATGCCATTGAAAATTA  7000

v.1  6965  ttaatcagaagaaaattaagcagggtctttgctatacaaaagtgttttcc  7014
           ||||||||||||||||||||||||||||||||||||||||||||||||||
v.7  7001  TTAATCAGAAGAAAATTAAGCAGGGTCTTTGCTATACAAAAGTGTTTTCC  7050

v.1  7015  actaattttgcatgcgtatttataagaaaaatgtgaatttggtggtttta  7064
           ||||||||||||||||||||||||||||||||||||||||||||||||||
v.7  7051  ACTAATTTTGCATGCGTATTTATAAGAAAAATGTGAATTTGGTGGTTTTA  7100

v.1  7065  ttctatcggtataaaggcatcgatatttagatgcacccgtgtttgtaaa  7114
           ||||||||||||||||||||||||||||||||||||||||||||||||||
v.7  7101  TTCTATCGGTATAAAGGCATCGATATTTAGATGCACCCGTGTTTGTAAA  7150

v.1  7115  aatgtagagcacaatggaattatgctggaagtctcaaataatatttttt  7164
           ||||||||||||||||||||||||||||||||||||||||||||||||||
v.7  7151  AATGTAGAGCACAATGGAATTATGCTGGAAGTCTCAAATAATATTTTTTT  7200

v.1  7165  cctattttatactcatggaagagataagctaaagaggggacaataatgag  7214
           ||||||||||||||||||||||||||||||||||||||||||||||||||
v.7  7201  CCTATTTTATACTCATGGAAGAGATAAGCTAAAGAGGGGACAATAATGAG  7250

v.1  7215  aaatgttggtgtgcttttctaagcatttaaaacataattgccaattgaaa  7264
           ||||||||||||||||||||||||||||||||||||||||||||||||||
v.7  7251  AAATGTTGGTGTGCTTTTCTAAGCATTTAAAACATAATTGCCAATTGAAA  7300

v.1  7265  ccctaaatatgtttacataccattaagatatgattcatgtaacaatgtta  7314
           ||||||||||||||||||||||||||||||||||||||||||||||||||
v.7  7301  CCCTAAATATGTTTACATACCATTAAGATATGATTCATGTAACAATGTTA  7350
```

TABLE LIIIf-continued

Nucleotide sequence alignment of 282P1G03 v.1 (SEQ ID NO: 182) and 282P1G03 v.7 (SEQ ID NO: 183)

```
v.1  7315  aattaattataatgggattgggtttgttatctgtggtagtatatatccta  7364
           ||||||||||||||||||||||||||||||||||||||||||||||||||
v.7  7351  AATTAATTATAATGGGATTGGGTTTGTTATCTGTGGTAGTATATATCCTA  7400

v.1  7365  gtgttcctatagtgaaataagtagggttcagccaaagctttctttgtttt  7414
           ||||||||||||||||||||||||||||||||||||||||||||||||||
v.7  7401  GTGTTCCTATAGTGAAATAAGTAGGGTTCAGCCAAAGCTTTCTTTGTTTT  7450

v.1  7415  gtaccttaaattgttcgattacgtcatcaaaagagatgaaaggtatgtag  7464
           ||||||||||||||||||||||||||||||||||||||||||||||||||
v.7  7451  GTACCTTAAATTGTTCGATTACGTCATCAAAAGAGATGAAAGGTATGTAG  7500

v.1  7465  aacaggttcacgtgattaccttttttcttttggcttggattaatattcata  7514
           ||||||||||||||||||||||||||||||||||||||||||||||||||
v.7  7501  AACAGGTTCACGTGATTACCTTTTTCTTTTGGCTTGGATTAATATTCATA  7550

v.1  7515  gtagaactttataaaacgtgtttgtattgtaggtggtgtttgtattatgc  7564
           ||||||||||||||||||||||||||||||||||||||||||||||||||
v.7  7551  GTAGAACTTTATAAAACGTGTTTGTATTGTAGGTGGTGTTTGTATTATGC  7600

v.1  7565  ttatgactatgtatggtttgaaaatattttcattatacatgaaattcaac  7614
           ||||||||||||||||||||||||||||||||||||||||||||||||||
v.7  7601  TTATGACTATGTATGGTTTGAAAATATTTTCATTATACATGAAATTCAAC  7650

v.1  7615  tttccaaataaaagttctacttcatgtaatccaaaa 7650
           ||||||||||||||||||||||||||||||||||||
v.7  7651  TTTCCAAATAAAAGTTCTACTTCATGTAATCCAAAA 7686
```

TABLE LIVf

Peptide sequences of protein coded by 282P1G03 v.7

(SEQ ID NO:184)

```
MEPLLLGRGL IVYLMFLLLK FSKAIEIPSS VQQVPTIIKQ SKVQVAFPFD EYFQIECEAK  60

GNPEPTFSWT KDGNPFYFTD HRIIPSNNSG TFRIPNEGHI SHFQGKYRCF ASNKLGIAMS  120

EEIEFIVPSV PKLPKEKIDP LEVEEGDPIV LPCNPPKGLP PLHIYWMNIE LEHIEQDERV  180

YMSQKGDLYF ANVEEKDSRN DYCCFAAFPR LRTIVQKMPM KLTVNSLKHI NDSSSSTEIG  240

SKANSIKQRK PKLLLPPTES GSESSITILK GETLLLECFA EGLPTPQVDW NKIGGDLPKG  300

RETKENYGKT LKIENVSYQD KGNYRCTASN FLGTATHDFH VIVEDNISHE LFTLHPEPPR  360

WTKKPQSAVY STGSNGILLC EAEGEPQPTI KWRVNGSPVD NHPFAGDVVF PREISFTNLQ  420

PNHTAVYQCE ASNVHGTTLA NANIDVVDVR PLIQTKDGEN YATVVGYSAF LHCEFFASPE  480

AVVSWQKVEE VKPLEGRRYH IYENGTLQIN RTTEEDAGSY SCWVENAIGK TAVTANLDIR  540

NATKLRVSPK NPRIPKLHML ELHCESKCDS HLKHSLKLSW SKDGEAFEIN GTEDGRIIID  600

GANLTISNVT LEDQGIYCCS AHTALDSAAD ITQVTVLDVP DPPENLHLSE RQNRSVRLTW  660

EAGADHNSNI SEYIVEFEGN KEEPGRWEEL TRVQGKKTTV ILPLAPFVRY QFRVIAVNEV  720

GRSQPSQPSD HHETPPAAPD RNPQNIRVQA SQPKEMIIKW EPLKSMEQNG PGLEYRVTWK  780

PQGAPVEWEE ETVTNHTLRV MTPAVYAPYD VKVQAINQLG SGPDPQSVTL YSGEDYPDTA  840

PVIHGVDVIN STLVKVTWST VPKDRVHGRL KGYQINWWKT KSLLDGRTHP KEVNILRFSG  900

QRNSGMVPSL DAFSEFHLTV LAYNSKGAGP ESEPYIFQTP EGVPEQPTFL KVIKVDKDTA  960

TLSWGLPKKL NGNLTGYLLQ YQIINDTYEI GELNDINITT PSKPSWHLSN LNATTKYKFY  1020

LRACTSQGCG KPITEESSTL GEGSKGIGKI SGVNLTQKTH PIEVFEPGAE HIVRLMTKNW  1080

GDNDSIFQDV IETRGREYAG LYDDISTQGW FIGLMCAIAL LTLLLLTVCF VKRNRGGKYS  1140
```

TABLE LIVf-continued

| Peptide sequences of protein coded by 282P1G03 v.7 |
| --- |
| VKEKEDLHPD PEIQSVKDET FGEYSDSDEK PLKGSLRSLN RDMQPTESAD SLVEYGEGDH 1200 |
| GLFSEDGSFI GAYAGSKEKG SVESNGSSTA TFPLPA 1236 |

TABLE LVf

Amino acid sequence alignment of 282P1G03 v.1 (SEQ ID NO: 185) and 282P1G03 v.7 (SEQ ID NO: 186)

```
v.1    1  MEPLLLGRGLIVYLMFLLLKFSKAIEIPSSVQQVPTIIKQSKVQVAFPFD  50
          ||||||||||||||||||||||||||||||||||||||||||||||||||
v.7    1  MEPLLLGRGLIVYLMFLLLKFSKAIEIPSSVQQVPTIIKQSKVQVAFPFD  50

v.1   51  EYFQIECEAKGNPEPTFSWTKDGNPFYFTDHRIIPSNNSGTFRIPNEGHI  100
          ||||||||||||||||||||||||||||||||||||||||||||||||||
v.7   51  EYFQIECEAKGNPEPTFSWTKDGNPFYFTDHRIIPSNNSGTFRIPNEGHI  100

v.1  101  SHFQGKYRCFASMKLGIAMSEEIEFIVPSVPKLPKEKIDPLEVEEGDPIV  150
          |||||||||||| |||||||||||||||||||||||||||||||||||||
v.7  101  SHFQGKYRCFASNKLGIAMSEEIEFIVPSVPKLPKEKIDPLEVEEGDPIV  150

v.1  151  LPCNPPKGLPPLHIYWMNIELEHIEQDERVYMSQKGDLYFANVEEKDSRN  200
          ||||||||||||||||||||||||||||||||||||||||||||||||||
v.7  151  LPCNPPKGLPPLHIYWMNIELEHIEQDERVYMSQKGDLYFANVEEKDSRN  200

v.1  201  DYCCFAAFPRLRTIVQKMPMKLTVNSLKHANDSSSSTEIGSKANSIKQRK  250
          ||||||||||||||||||||||||||||||||||||||||||||||||||
v.7  201  DYCCFAAFPRLRTIVQKMPMKLTVNSLKHANDSSSSTEIGSKANSIKQRK  250

v.1  251  PKLLLPPTESGSESSITILKGEILLLECFAEGLPTPQVDWNKIGGDLPKG  300
          ||||||||||||||||||||||||||||||||||||||||||||||||||
v.7  251  PKLLLPPTESGSESSITILKGEILLLECFAEGLPTPQVDWNKIGGDLPKG  300

v.1  301  RETKEHYGKTLKIENVSYQDKGNYRCTASNFLGTATHDFHVIVE------  344
          ||||| ||||||||||||||||||||||||||||||||||||||
v.7  301  RETKENYGKTLKIENVSYQDKGNYRCTASNFLGTATHDFHVIVEDNISHE  350

v.1  345  ------EPPRWTKKPQSAVYSTGSNGILLCEAEGEPQPTIKWRVNGSPVD  388
                ||||||||||||||||||||||||||||||||||||||||||||
v.7  351  LFTLHPEPPRWTKKPQSAVYSTGSNGILLCEAEGEPQPTIKWRVNGSPVD  400

v.1  389  NHPFAGDVVFPREISFTNLQPHHTAVYQCEASNVHGTILANANIDVVDVR  438
          ||||||||||||||||||||| ||||||||||||||||||||||||||||
v.7  401  NHPFAGDVVFPREISFTNLQPNHTAVYQCEASNVHGTILANANIDVVDVR  450

v.1  439  PLIQTKDGENYATVVGYSAFLHCEFFASPEAVVSWQKVEEVKPLEGRRYH  488
          ||||||||||||||||||||||||||||||||||||||||||||||||||
v.7  451  PLIQTKDGENYATVVGYSAFLHCEFFASPEAVVSWQKVEEVKPLEGRRYH  500

v.1  489  IYENGTLQINRTTEEDAGSYSCWVENAIGKTAVTANLDIRNATKLRVSPK  538
          ||||||||||||||||||||||||||||||||||||||||||||||||||
v.7  501  IYENGTLQINRTTEEDAGSYSCWVENAIGKTAVTANLDIRNATKLRVSPK  550

v.1  539  NPRIPKLHMLELHCESKCDSHLKHSLKLSWSKDGEAFEINGTEDGRIIID  588
          ||||||||||||||||||||||||||||||||||||||||||||||||||
v.7  551  NPRIPKLHMLELHCESKCDSHLKHSLKLSWSKDGEAFEINGTEDGRIIID  600

v.1  589  GANLTISNVTLEDQGIYCCSAHTALDSAADITQVTVLDVPDPPENLHLSE  638
          ||||||||||||||||||||||||||||||||||||||||||||||||||
v.7  601  GANLTISNVTLEDQGIYCCSAHTALDSAADITQVTVLDVPDPPENLHLSE  650

v.1  639  RQNRSVRLTWEAGADHNSNISEYIVEFEGNKEEPGRWEELTRVQGKKTTV  688
          ||||||||||||||||||||||||||||||||||||||||||||||||||
v.7  651  RQNRSVRLTWEAGADHNSNISEYIVEFEGNKEEPGRWEELTRVQGKKTTV  700

v.1  689  ILPLAPFVRYQFRVIAVNEVGRSQPSQPSDHHETPPAAPDRNPQNIRVQA  738
          ||||||||||||||||||||||||||||||||||||||||||||||||||
v.7  701  ILPLAPFVRYQFRVIAVNEVGRSQPSQPSDHHETPPAAPDRNPQNIRVQA  750

v.1  739  SQPKEMIIKWEPLKSMEQNGPGLEYRVTWKPQGAPVEWEEETVTNHTLRV  788
          |||||||||||||||||| |||||||||||||||||||||||||||||||
v.7  751  SQPKEMIIKWEPLKSMEQMGPGLEYRVTWKPQGAPVEWEEETVTNHTLRV  800

v.1  789  MTPAVYAPYDVKVQAINQLGSGPDPQSVTLYSGEDYPDTAPVIHGVDVIN  838
          ||||||||||||||||||||||||||||||||||||||||||||||||| 
v.7  801  MTPAVYAPYDVKVQAINQLGSGPDPQSVTLYSGEDYPDTAPVIHGVDVIH  850
```

TABLE LVf-continued

Amino acid sequence alignment of 282P1G03 v.1 (SEQ ID NO: 185) and 282P1G03 v.7 (SEQ ID NO: 186)

v.1 839 STLVKVTWSTVPKDRVHGRLKGYQINWWKTKSLLDGRTHPKEVNILRFSG 888
||||||||||||||||||||||||||||||||||||||||||||||||||
v.7 851 STLVKVTWSTVPKDRVHGRLKGYQIHWWKTKSLLDGRTHPKEVNILRFSG 900 v.1 889 QRNSGMVPSLDAFSEFHLTVLAYNSKGAGPESEPYIFQTPEGVPEQPTFL 938
||||||||||||||||||||||||||||||||||||||||||||||||||
v.7 901 QRNSGMVPSLDAFSEFHLTVLAYNSKGAGPESEPYIFQTPEGVPEQPTFL 950 v.1 939 KVIKVDKDTATLSWGLPKKLHGNLTGYLLQYQIINDTYEIGELNDINITT 988
||||||||||||||||||||||||||||||||||||||||||||||||||
v.7 951 KVIKVDKDTATLSWGLPKKLNGNLTGYLLQYQIINDTYEIGELNDINITT 1000 v.1 989 PSKPSWHLSNLNATTKYKFYLRACTSQGCGKPITEESSTLGEGSKGIGKI 1038
||||||||||||||||||||||||||||||||||||||||||||||||||
v.7 1001 PSKPSWHLSNLNATTKYKFYLRACTSQGCGKPITEESSTLGEGSKGIGKI 1050 v.1 1039 SGVNLTQKTHPIEVFEPGAEHIVRLMTKNWGDNDSIFQDVIETRGREYAG 1088
||||||||||||||||||||||||||||||||||||||||||||||||||
v.7 1051 SGVNLTQKTHPIEVFEPGAEHIVRLMTKNWGDNDSTFQDVIETRGREYAG 1100 v.1 1089 LYDDISTQGWFIGLMCAIALLTLLLLTVCFVKRNRGGKYSVKEKEDLHPD 1138
||||||||||||||||||||||||||||||||||||||||||||||||||
v.7 1101 LYDDISTQGWFIGLMCAIALLTLLLLTVCFVKRHRGGKYSVKEKEDLHPD 1150 v.1 1139 PEIQSVKDETFGEYSDSDEKPLKGSLRSLNRDMQPTESADSLVEYGEGDH 1188
||||||||||||||||||||||||||||||||||||||||||||||||||
v.7 1151 PEIQSVKDETFGEYSDSDEKPLKGSLRSLNRDMQPTESADSLVEYGEGDH 1200 v.1 1189 GLFSEDGSFIGAYAGSKEKGSVESNGSSTATFPLRA 1224
||||||||||||||||||||||||||||||||||||
v.7 1201 GLFSEDGSFIGAYAGSKEKGSVESNGSSTATFPLRA 1236

TABLE LIIg

Nucleotide sequence of transcript variant 282P1G03 v.8

(SEQ ID NO:187)

cggaccctgc gcgcccccgt cccggctccc ggccggctcg ggggagaagg cgcccgaggg 60
gaggcgccgg acagatcgcg tttcggaggc ggcgcaggtg ctgtaaactg caaaccataa 120
tcctgtctta atactgcaaa caaatcatag tggaactaag ggaacttaa tttactgttt 180 ccaggttaac taaggtctca gctgtaaacc aaaagtgaga ggaqacatta agattttcat 240 tcttaccggg ttgtcttctt cctgaagagc aatggagccg cttttacttg gaagaggact 300
aatcgtatat ctaatgttcc tcctgttaaa attctcaaaa gcaattgaaa taccatcttc 360
agttcaacag gttccaacaa tcataaaaca gtcaaaagtc caagttgcct ttcccttcga 420
tgagtatttt caaattgaat gtgaagctaa aggaaatcca gaaccaacat tttcgtggac 480
taaggatggc aacccttttt atttcactga ccatcggata attccatcga acaattcagg 540
aacattcagg atcccaaacg aggggcacat atctcacttt caagggaaat accgctgcct 600
tgcttcaaat aaactgggaa tcgctatgtc agaagaaata gaatttatag ttccaaaatt 660
agaacacatc gaacaagatg aaagagtata catgagccaa aagggagatc tatacttcgc 720
aaacgtggaa gaaaaggaca gtcgcaatga ctactgttgc tttgctgcat ttccaagatt 780
aaggactatt gtacagaaaa tgccaatgaa actaacagtt aacagtttaa agcatgctaa 840
tgactcaagt tcatccacag aaattggttc caaggcaaat tccatcaagc aaagaaaacc 900
caaactgctg ttgcctccca ctgagagtgg cagtgagtct tcaattacca tcctcaaagg 960
ggaaatcttg ctgcttgagt gttttgctga aggcttgcca actccacagg ttgattggaa 1020
caaaattggt ggtgacttac caaaggggag agaaacaaaa gaaaattatg gcaagacttt 1080

TABLE LIIg-continued

| Nucleotide sequence of transcript variant 282P1G03 v.8 |
|---|
| gaagatagag aatgtctcct accaggacaa aggaaattat cgctgcacag ccagcaattt 1140 |
| cttgggaaca gccactcacg attttcacgt tatagtagaa gataacatct ctcatgagct 1200 |
| cttcacttta catccagagc ctcctcgctg gacaaagaag cctcagagtg ctgtgtatag 1260 |
| caccggaagc aatggcatct tgttatgtga ggctgaagga gaacctcaac ccacaatcaa 1320 |
| gtggagagtc aatggctccc cagttgacaa tcatccattt gctggtgatg ttgtcttccc 1380 |
| cagggaaatc agttttacca accttcaacc aaatcatact gctgtgtacc agtgtgaagc 1440 |
| ctcaaatgtc catggaacta tccttgccaa tgccaatatt gatgttgtgg atgtccgtcc 1500 |
| attgatacaa accaaagatg gagaaaatta cgctacagtg gttgggtaca gtgctttctt 1560 |
| acattgcgag ttctttgctt cacctgaggc agtcgtgtcc tggcagaagg tggaagaagt 1620 |
| gaaacccctg gagggcaggc ggtatcatat ctatgaaaat ggcacattgc agatcaacag 1680 |
| aaccaccgaa gaagatgctg ggtcttactc atgttgggta gaaaatgcta taggaaaaac 1740 |
| tgcagtcaca gccaatttgg atattagaaa tgctacaaaa cttagagttt ctcctaagaa 1800 |
| tcctcgtatc cccaaattgc atatgcttga attacattgt gaaagcaaat gtgactcaca 1860 |
| tttgaaacac agtttgaagt tgtcctggag taaagatgga gaagcctttg aaattaatgg 1920 |
| cacagaagat ggcaggataa ttattgatgg agctaatttg accatatcta atgtaacttt 1980 |
| agaggaccaa ggtatttact gctgttcagc tcatactgct ctagacagtg ctgccgatat 2040 |
| aactcaagta actgttcttg atgttccgga tccaccagaa aaccttcact tgtctgaaag 2100 |
| acagaacagg agtgttcggc tgacctggga agctggagct gaccacaaca gcaatattag 2160 |
| cgagtatatt gttgaatttg aaggaaacaa agaagagcct ggaaggtggg aggaactgac 2220 |
| cagagtccaa ggaaagaaaa ccacagttat cttacctttg gctccatttg tgagatacca 2280 |
| gttcagggtc atagccgtga acgaagtagg gagaagtcag cctagccagc cgtcagacca 2340 |
| tcatgaaaca ccaccagcag ctccagatag gaatccacaa aacataaggg ttcaagcctc 2400 |
| tcaacccaag gaaatgatta taaagtggga gcctttgaaa tccatggagc agaatggacc 2460 |
| aggcctagag tacagagtga cctggaagcc acagggagcc ccagtggagt gggaagaaga 2520 |
| aacagtcaca aaccacacat tgcgggtgat gacgcctgct gtctatgccc cttatgatgt 2580 |
| caaggtccag gctatcaatc aactaggatc tgggcctgac cctcagtcag tgactctcta 2640 |
| ttctggagaa gactatcctg atacagctcc agtgatccat ggggtggacg ttataaacag 2700 |
| tacattagtt aaagttacct ggtcaacagt tccaaaggac agagtacatg gacgtctgaa 2760 |
| aggctatcag ataaattggt ggaaaacaaa aagtctgttg gatggaagaa cacatcccaa 2820 |
| agaagtgaac attctaagat tttcaggaca aagaaactct ggaatggttc cttccttaga 2880 |
| tgcctttagt gaatttcatt taacagtctt agcctataac tctaaaggag ctggtcctga 2940 |
| aagtgagcct tatatatttc aaacaccaga aggagtacct gaacagccaa cttttctaaa 3000 |
| ggtcatcaaa gttgataaag acactgccac tttatcttgg ggactaccta agaaattaaa 3060 |
| tggaaactta actggctatc ttttgcaata tcagataata aatgacacct acgagattgg 3120 |
| agaattaaat gatattaaca ttacaactcc atcaaagccc agctggcacc tctcaaacct 3180 |
| gaatgcaact accaagtaca aattctactt gagggcttgc acttcacagg gctgtggaaa 3240 |
| accgatcacg gaggaaagct ccaccttagg agaagggagt aaaggtatcg ggaagatatc 3300 |
| aggagtaaat cttactcaaa agactcaccc aatagaggta tttgagccgg gagctgaaca 3360 |

TABLE LIIg-continued

| Nucleotide sequence of transcript variant 282P1G03 v.8 | |
|---|---|
| tatagttcgc ctaatgacta agaattgggg cgataacgat agcatttttc aagatgtaat | 3420 |
| tgagacaaga gggagagaat atgctggttt atatgatgac atctccactc aaggctggtt | 3480 |
| tattggactg atgtgtgcga ttgctcttct cacactacta ttattaactg tttgctttgt | 3540 |
| gaagaggaat agaggtggaa agtactcagt taaagaaaag gaagatttgc atccagaccc | 3600 |
| agaaattcag tcagtaaaag atgaaacctt tggtgaatac agtgacagtg atgaaaagcc | 3660 |
| tctcaaagga agccttcggt cccttaatag ggatatgcag cctactgaaa gtgctgacag | 3720 |
| cttagtcgaa tacggagagg gagaccatgg tctcttcagt gaagatggat catttattgg | 3780 |
| tgcctacgct ggatctaagg agaagggatc tgttgaaagc aatggaagtt ctacagcaac | 3840 |
| ttttcccctt cgggcataaa cacaacatat gtaagcaacg ctactggttc accccaacct | 3900 |
| tccatattta tctgttcaaa ggagcaagaa ctttcatata ggaatagaaa catgctggcc | 3960 |
| gaagatttca tccagaagtc aacatcctgc aattatgttg aaaagagtag tactttcttc | 4020 |
| aaaatataaa atgccaagca cttcaggcct atgttttgct tatattgttt tcaggtgctc | 4080 |
| aaaatgcaaa acacaaaaca aatcctgcat ttagatacac ctcaactaaa tccaaagtcc | 4140 |
| ccattcagta tattccatat ttgcctgatt ttactattcg gtgtgtttgc atagatgttg | 4200 |
| ctacttggtg ggtttttctc cgtatgcaca ttggtataca gtctctgaga actggcttgg | 4260 |
| tgactttgct tcactacagg ttaaaagacc ataagcaaac tggttattta aaatgtaaaa | 4320 |
| aggaatatga aagtcttatt aaaacacttc attgaaaata tacagtctaa atttattatt | 4380 |
| taaattttac tagcaaaagt cttaggtgaa caatcaacta gtatttgttg agctcctatt | 4440 |
| tgcccagaga tggtcatatt taaacagaag tatacgtttt tcagtttcaa catgaatttt | 4500 |
| tttatttctg tcagttatga catccacgag catcactttt tgtgtctgtt tttttttttt | 4560 |
| tcttggacta aattcaactg catggaagcg gtggtcagaa ggttgtttta tacgagaaca | 4620 |
| ggcagaaagt gcccattgtt caggattcta atagctacat ctacttaata tcttcatttc | 4680 |
| taaattgact gcttttacct ttttctcatg tttatataat ggtatgcttg catatatttc | 4740 |
| atgaatacat tgtacatatt atgttaatat ttacacaatt taaaatatag atgtgtttta | 4800 |
| ttttgaagtg agaaaatgaa cattaacagg catgtttgta cagctagaat atattagtaa | 4860 |
| gatactgttt ttcgtcattc cagagctaca actaataaca cgaggttcca aagctgaaga | 4920 |
| ctttgtataa agtatttggg ttttgttctt gtattgcttt ctttcaacag tttcaaaata | 4980 |
| aaatatcata caaatattga gggaaatgtt ttcatatttt tcaaaatagg tttttattgt | 5040 |
| tgaatgtaca tctaccccag cccctcaaaa gaaaaactgt ttacatagaa attcctacac | 5100 |
| atacgtttgc gtatatgtta ttttaaacat ctttgtggtg agaatttttt ccccgatatt | 5160 |
| ctccttctgt caaagtcaga acaaattcag ggaatttatt ttctggcagt tgtgctccag | 5220 |
| tcctttttaaa attgtacatg aacatgtttt agaaacaata tggaggatga tgcatacatg | 5280 |
| tcggtcaagt tcagcgctcg acattttatg gaaagatttt tttaacctta ccacgaaata | 5340 |
| cttaactact gtttaagtga attgacttat ttcactttag tttttgaact gtgattattg | 5400 |
| gtatactgtt atatcctcaa cttggattta tggtaacccc ttttagttca tggagaccaa | 5460 |
| aatttggggt atttataata gtcagcgcag gaatgcacat ggaatatcta cttgtccttt | 5520 |
| tgaacctcac gagtcatcca gaatgtatag acaggaaaag catgtcttat ttaaaactgt | 5580 |
| aatttatggg ctcaggatct gaccgcagtc ccgggagtaa gcatttcaaa gggggaaggc | 5640 |
| agtgtggtcc ctaccctgtg tgaatgtgag gatgtagaca tccatcagtg caactcgagc | 5700 |

TABLE LIIg-continued

| Nucleotide sequence of transcript variant 282P1G03 v.8 |
|---|
| tccatcctcc tccgatttct aaggctccag ttttctggag ggacagtcat catgttttga 5760 |
| tttatctggg agaaaactgt ggtgcacagc ttgtgaggag ggcaaggttg tgacgttcga 5820 |
| gcttagttct ggtgttattc tgtctcctct tctttgtcat cagccaaaac gtggttttta 5880 |
| aagagagtca tgcaggttag aaataatgtc aaaaatattt aggaatttaa taacctttaa 5940 |
| gtcagaaact aaaacaaata ctgaaatatt agctcttcct acacttcgtg ttccccttta 6000 |
| gctgcctgaa aatcaagatt gctcctactc agatcttctg agtggctaaa acttatggat 6060 |
| atgaaaaatg agattgaatg atgactatgc tttgctatca ttgttacctt tcctcaatac 6120 |
| tatttggcaa ctactgggac tcttcagcac aaaaggaata gatctatgat tgaccctgat 6180 |
| tttaattgtg aaattatatg attcatatat tttatgaatc agaataacct tcaaataaaa 6240 |
| taaatctaag tcggttaaaa tggatttcat gattttccct cagaaaatga gtaacggagt 6300 |
| ccacggcgtg caatggtaat tataaattgg tgatgcttgt ttgcaaattg cccactcgtg 6360 |
| ataagtcaac agccaatatt taaaactttg ttcgttactg gctttaccct aactttctct 6420 |
| agtctactgt caatatcatt ttaatgtaat tgattgtata tagtctcaag aatggttggt 6480 |
| gggcatgagt tcctagagaa ctgtccaagg gttgggaaaa tccaaattct cttcctggct 6540 |
| ccagcactga ttttgtacat aaacattagg caggttgctt aaccttttta tttcaaactc 6600 |
| tctcaactct aaagtgctaa taataatctc agttacctta tctttgtcac agggtgttct 6660 |
| tttttatgaa gaaaaatttg aaaatgataa aagctaagat gccttctaac ttcataagca 6720 |
| aacctttaac taattatgta tctgaaagtc acccccacat accaactcaa ctttttttcct 6780 |
| gtgaacacat aaatatattt ttatagaaaa acaaatctac ataaaataaa tctactgttt 6840 |
| agtgagcagt atgacttgta catgccattg aaaattatta atcagaagaa aattaagcag 6900 |
| ggtctttgct atacaaaagt gttttccact aattttgcat gcgtatttat aagaaaaatg 6960 |
| tgaatttggt ggttttattc tatcggtata aaggcatcga tattttagat gcacccgtgt 7020 |
| ttgtaaaaat gtagagcaca atggaattat gctggaagtc tcaaataata ttttttttcct 7080 |
| attttatact catggaagag ataagctaaa gaggggacaa taatgagaaa tgttggtgtg 7140 |
| cttttctaag catttaaaac ataattgcca attgaaaccc taaatatgtt tacataccat 7200 |
| taagatatga ttcatgtaac aatgttaaat taattataat gggattgggt ttgttatctg 7260 |
| tggtagtata tatcctagtg ttcctatagt gaaataagta gggttcagcc aaagctttct 7320 |
| ttgttttgta ccttaaattg ttcgattacg tcatcaaaag agatgaaagg tatgtagaac 7380 |
| aggttcacgt gattaccttt ttcttttggc ttggattaat attcatagta gaactttata 7440 |
| aaacgtgttt gtattgtagg tggtgtttgt attatgctta tgactatgta tggtttgaaa 7500 |
| atattttcat tatacatgaa attcaacttt ccaaataaaa gttctacttc atgtaatcca 7560 |
| aaa 7563 |

TABLE LIIIg

| Nucleotide sequence alignment of 282P1G03 v.1 (SEQ ID NO: 188) and 282P1G03 v.8 (SEQ ID NO: 189) | | | |
|---|---|---|---|
| v.1 | 1 | cggaccctgcgcgcccccgtcccggctcccggccggctcgggggagaagg | 50 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.8 | 1 | CGGACCCTGCGCGCCCCCGTCCCGGCTCCCGGCCGGCTCGGGGGAGAAGG | 50 |

TABLE LIIIg-continued

Nucleotide seguence alignment of 282P1G03 v.1 (SEQ ID NO: 188) and 282P1G03 v.8 (SEQ ID NO: 189)

```
v.1   51  cgcccgaggggaggcgccggacagatcgcgtttcggaggcggcgcaggtg  100
          ||||||||||||||||||||||||||||||||||||||||||||||||||
v.8   51  CGCCCGAGGGGAGGCGCCGGACAGATCGCGTTTCGGAGGCGGCGCAGGTG  100

v.1  101  ctgtaaactgcaaaccataatcctgtcttaatactgcaaacaaatcatag  150
          ||||||||||||||||||||||||||||||||||||||||||||||||||
v.8  101  CTGTAAACTGCAAACCATAATCCTGTCTTAATACTGCAAACAAATCATAG  150

v.1  151  tggaactaaggggaacttaatttactgtttccaggttaactaaggtctca  200
          ||||||||||||||||||||||||||||||||||||||||||||||||||
v.8  151  TGGAACTAAGGGGAACTTAATTTACTGTTTCCAGGTTAACTAAGGTCTCA  200

v.1  201  gctgtaaaccaaaagtgagaggagacattaagattttcattcttaccggg  250
          ||||||||||||||||||||||||||||||||||||||||||||||||||
v.8  201  GCTGTAAACCAAAAGTGAGAGGAGACATTAAGATTTTCATTCTTACCGGG  250

v.1  251  ttgtcttcttcctgaagagcaatggagccgcttttacttggaagaggact  300
          ||||||||||||||||||||||||||||||||||||||||||||||||||
v.8  251  TTGTCTTCTTCCTGAAGAGCAATGGAGCCGCTTTTACTTGGAAGAGGACT  300

v.1  301  aatcgtatatctaatgttcctcctgttaaaattctcaaaagcaattgaaa  350
          ||||||||||||||||||||||||||||||||||||||||||||||||||
v.8  301  AATCGTATATCTAATGTTCCTCCTGTTAAAATTCTCAAAAGCAATTGAAA  350

v.1  351  taccatcttcagttcaacaggttccaacaatcataaaacagtcaaaagtc  400
          ||||||||||||||||||||||||||||||||||||||||||||||||||
v.8  351  TACCATCTTCAGTTCAACAGGTTCCAACAATCATAAAACAGTCAAAAGTC  400

v.1  401  caagttgcctttcccttcgatgagtattttcaaattgaatgtgaagctaa  450
          ||||||||||||||||||||||||||||||||||||||||||||||||||
v.8  401  CAAGTTGCCTTTCCCTTCGATGAGTATTTTCAAATTGAATGTGAAGCTAA  450

v.1  451  aggaaatccagaaccaacattttcgtggactaaggatggcaacccttttt  500
          ||||||||||||||||||||||||||||||||||||||||||||||||||
v.8  451  AGGAAATCCAGAACCAACATTTTCGTGGACTAAGGATGGCAACCCTTTTT  500

v.1  501  atttcactgaccatcggataattccatcgaacaattcaggaacattcagg  550
          ||||||||||||||||||||||||||||||||||||||||||||||||||
v.8  501  ATTTCACTGACCATCGGATAATTCCATCGAACAATTCAGGAACATTCAGG  550

v.1  551  atcccaaacgaggggcacatatctcactttcaagggaaataccgctgctt  600
          ||||||||||||||||||||||||||||||||||||||||||||||||||
v.8  551  ATCCCAAACGAGGGGCACATATCTCACTTTCAAGGGAAATACCGCTGCTT  600

v.1  601  tgcttcaaataaactgggaatcgctatgtcagaagaaatagaatttatag  650
          ||||||||||||||||||||||||||||||||||||||||||||||||||
v.8  601  TGCTTCAAATAAACTGGGAATCGCTATGTCAGAAGAAATAGAATTTATAG  650

v.1  651  ttccaagtgttccaaaactcccaaaagaaaaaaattgaccctcttgaagtg  700
          ||||||
v.8  651  TTCCAA--------------------------------------------  656

v.1  701  gaggagggagatccaattgtcctcccatgcaatcctcccaaaggcctccc  750

v.8  657  --------------------------------------------------  656

v.1  751  acctttacacatttattggatgaatattgaattagaacacatcgaacaag  800
                                       |||||||||||||||||||||
v.8  657  -----------------------------AATTAGAACACATCGAACAAG  677

v.1  801  atgaaagagtatacatgagccaaaagggagatctatacttcgcaaacgtg  850
          ||||||||||||||||||||||||||||||||||||||||||||||||||
v.8  678  ATGAAAGAGTATACATGAGCCAAAAGGGAGATCTATACTTCGCAAACGTG  727

v.1  851  gaagaaaaggacagtcgcaatgactactgttgctttgctgcatttccaag  900
          ||||||||||||||||||||||||||||||||||||||||||||||||||
v.8  728  GAAGAAAAGGACAGTCGCAATGACTACTGTTGCTTTGCTGCATTTCCAAG  777

v.1  901  attaaggactattgtacagaaaatgccaatgaaactaacagttaacagtt  950
          ||||||||||||||||||||||||||||||||||||||||||||||||||
v.8  778  ATTAAGGACTATTGTACAGAAAATGCCAATGAAACTAACAGTTAACAGTT  827

v.1  951  taaagcatgctaatgactcaagttcatccacagaaattggttccaaggca  1000
          ||||||||||||||||||||||||||||||||||||||||||||||||||
v.8  828  TAAAGCATGCTAATGACTCAAGTTCATCCACAGAAATTGGTTCCAAGGCA  877
```

TABLE LIIIg-continued

Nucleotide sequence alignment of 282P1G03 v.1 (SEQ ID NO: 188) and 282P1G03 v.8 (SEQ ID NO: 189)

```
v.1  1001  aattccatcaagcaaagaaaacccaaactgctgttgcctcccactgagag  1050
           ||||||||||||||||||||||||||||||||||||||||||||||||||
v.8   878  AATTCCATCAAGCAAAGAAAACCCAAACTGCTGTTGCCTCCCACTGAGAG  927

v.1  1051  tggcagtgagtcttcaattaccatcctcaaaggggaaatcttgctgcttg  1100
           ||||||||||||||||||||||||||||||||||||||||||||||||||
v.8   928  TGGCAGTGAGTCTTCAATTACCATCCTCAAAGGGGAAATCTTGCTGCTTG  977

v.1  1101  agtgttttgctgaaggcttgccaactccacaggttgattggaacaaaatt  1150
           ||||||||||||||||||||||||||||||||||||||||||||||||||
v.8   978  AGTGTTTTGCTGAAGGCTTGCCAACTCCACAGGTTGATTGGAACAAAATT  1027

v.1  1151  ggtggtgacttaccaaaggggagagaaacaaaagaaaattatggcaagac  1200
           ||||||||||||||||||||||||||||||||||||||||||||||||||
v.8  1028  GGTGGTGACTTACCAAAGGGGAGAGAAACAAAAGAAAATTATGGCAAGAC  1077

v.1  1201  tttgaagatagagaatgtctcctaccaggacaaaggaaattatcgctgca  1250
           ||||||||||||||||||||||||||||||||||||||||||||||||||
v.8  1078  TTTGAAGATAGAGAATGTCTCCTACCAGGACAAAGGAAATTATCGCTGCA  1127

v.1  1251  cagccagcaatttcttgggaacagccactcacgattttcacgttatagta  1300
           ||||||||||||||||||||||||||||||||||||||||||||||||||
v.8  1128  CAGCCAGCAATTTCTTGGGAACAGCCACTCACGATTTTCACGTTATAGTA  1177

v.1  1301  ga------------------------------------agagcctcctcg  1314
           ||                                    ||||||||||||
v.8  1178  GAAcataacatctctcatgagctcttcactttacatccagAGCCTCCTCG  1227

v.1  1315  ctggacaaagaagcctcagagtgctgtgtatagcaccggaagcaatggca  1364
           ||||||||||||||||||||||||||||||||||||||||||||||||||
v.8  1228  CTGGACAAAGAAGCCTCAGAGTGCTGTGTATAGCACCGGAAGCAATGGCA  1277

v.1  1365  tcttgttatgtgaggctgaaggagaacctcaacccacaatcaagtggaga  1414
           ||||||||||||||||||||||||||||||||||||||||||||||||||
v.8  1278  TCTTGTTATGTGAGGCTGAAGGAGAACCTCAACCCACAATCAAGTGGAGA  1327

v.1  1415  gtcaatggctccccagttgacaatcatccatttgctggtgatgttgtctt  1464
           ||||||||||||||||||||||||||||||||||||||||||||||||||
v.8  1328  GTCAATGGCTCCCCAGTTGACAATCATCCATTTGCTGGTGATGTTGTCTT  1377

v.1  1465  ccccagggaaatcagttttaccaaccttcaaccaaatcatactgctgtgt  1514
           ||||||||||||||||||||||||||||||||||||||||||||||||||
v.8  1378  CCCCAGGGAAATCAGTTTTACCAACCTTCAACCAAATCATACTGCTGTGT  1427

v.1  1515  accagtgtgaagcctcaaatgtccatggaactatccttgccaatgccaat  1564
           ||||||||||||||||||||||||||||||||||||||||||||||||||
v.8  1428  ACCAGTGTGAAGCCTCAAATGTCCATGGAACTATCCTTGCCAATGCCAAT  1477

v.1  1565  attgatgttgtggatgtccgtccattgatacaaaccaaagatggagaaaa  1614
           ||||||||||||||||||||||||||||||||||||||||||||||||||
v.8  1478  ATTGATGTTGTGGATGTCCGTCCATTGATACAAACCAAAGATGGAGAAAA  1527

v.1  1615  ttacgctacagtggttgggtacagtgctttcttacattgcgagttctttg  1664
           ||||||||||||||||||||||||||||||||||||||||||||||||||
v.8  1528  TTACGCTACAGTGGTTGGGTACAGTGCTTTCTTACATTGCGAGTTCTTTG  1577

v.1  1665  cttcacctgaggcagtcgtgtcctggcagaaggtggaagaagtgaaaccc  1714
           ||||||||||||||||||||||||||||||||||||||||||||||||||
v.8  1578  CTTCACCTGAGGCAGTCGTGTCCTGGCAGAAGGTGGAAGAAGTGAAACCC  1627

v.1  1715  ctggagggcaggcggtatcatatctatgaaaatggcacattgcagatcaa  1764
           ||||||||||||||||||||||||||||||||||||||||||||||||||
v.8  1628  CTGGAGGGCAGGCGGTATCATATCTATGAAAATGGCACATTGCAGATCAA  1677

v.1  1765  cagaaccaccgaagaagatgctgggtcttactcatgttgggtagaaaatg  1814
           ||||||||||||||||||||||||||||||||||||||||||||||||||
v.8  1678  CAGAACCACCGAAGAAGATGCTGGGTCTTACTCATGTTGGGTAGAAAATG  1727

v.1  1815  ctataggaaaaactgcagtcacagccaatttggatattagaaatgctaca  1864
           ||||||||||||||||||||||||||||||||||||||||||||||||||
v.8  1728  CTATAGGAAAAACTGCAGTCACAGCCAATTTGGATATTAGAAATGCTACA  1777

v.1  1865  aaacttagagtttctcctaagaatcctcgtatccccaaattgcatatgct  1914
           ||||||||||||||||||||||||||||||||||||||||||||||||||
v.8  1778  AAACTTAGAGTTTCTCCTAAGAATCCTCGTATCCCCAAATTGCATATGCT  1827
```

TABLE LIIIg-continued

Nucleotide seguence alignment of 282P1G03 v.1 (SEQ ID NO: 188) and 282P1G03 v.8 (SEQ ID NO: 189)

```
v.1  1915  tgaattacattgtgaaagcaaatgtgactcacatttgaaacacagtttga  1964
           ||||||||||||||||||||||||||||||||||||||||||||||||||
v.8  1828  TGAATTACATTGTGAAAGCAAATGTGACTCACATTTGAAACACAGTTTGA  1877

v.1  1965  agttgtcctggagtaaagatggagaagcctttgaaattaatggcacagaa  2014
           ||||||||||||||||||||||||||||||||||||||||||||||||||
v.8  1878  AGTTGTCCTGGAGTAAAGATGGAGAAGCCTTTGAAATTAATGGCACAGAA  1927

v.1  2015  gatggcaggataattattgatggagctaatttgaccatatctaatgtaac  2064
           ||||||||||||||||||||||||||||||||||||||||||||||||||
v.8  1928  GATGGCAGGATAATTATTGATGGAGCTAATTTGACCATATCTAATGTAAC  1977

v.1  2065  tttagaggaccaaggtatttactgctgttcagctcatactgctctagaca  2114
           ||||||||||||||||||||||||||||||||||||||||||||||||||
v.8  1978  TTTAGAGGACCAAGGTATTTACTGCTGTTCAGCTCATACTGCTCTAGACA  2027

v.1  2115  gtgctgccgatataactcaagtaactgttcttgatgttccggatccacca  2164
           ||||||||||||||||||||||||||||||||||||||||||||||||||
v.8  2028  GTGCTGCCGATATAACTCAAGTAACTGTTCTTGATGTTCCGGATCCACCA  2077

v.1  2165  gaaaaccttcacttgtctgaaagacagaacaggagtgttcggctgacctg  2214
           ||||||||||||||||||||||||||||||||||||||||||||||||||
v.8  2078  GAAAACCTTCACTTGTCTGAAAGACAGAACAGGAGTGTTCGGCTGACCTG  2127

v.1  2215  ggaagctggagctgaccacaacagcaatattagcgagtatattgttgaat  2264
           ||||||||||||||||||||||||||||||||||||||||||||||||||
v.8  2128  GGAAGCTGGAGCTGACCACAACAGCAATATTAGCGAGTATATTGTTGAAT  2177

v.1  2265  ttgaaggaaacaaagaagagcctggaaggtgggaggaactgaccagagtc  2314
           ||||||||||||||||||||||||||||||||||||||||||||||||||
v.8  2178  TTGAAGGAAACAAAGAAGAGCCTGGAAGGTGGGAGGAACTGACCAGAGTC  2227

v.1  2315  caaggaaagaaaaccacagttatcttacctttggctccatttgtgagata  2364
           ||||||||||||||||||||||||||||||||||||||||||||||||||
v.8  2228  CAAGGAAAGAAAACCACAGTTATCTTACCTTTGGCTCCATTTGTGAGATA  2277

v.1  2365  ccagttcagggtcatagccgtgaacgaagtagggagaagtcagcctagcc  2414
           ||||||||||||||||||||||||||||||||||||||||||||||||||
v.8  2278  CCAGTTCAGGGTCATAGCCGTGAACGAAGTAGGGAGAAGTCAGCCTAGCC  2327

v.1  2415  agccgtcagaccatcatgaaacaccaccagcagctccagataggaatcca  2464
           ||||||||||||||||||||||||||||||||||||||||||||||||||
v.8  2328  AGCCGTCAGACCATCATGAAACACCACCAGCAGCTCCAGATAGGAATCCA  2377

v.1  2465  caaaacataagggttcaagcctctcaacccaaggaaatgattataaagtg  2514
           ||||||||||||||||||||||||||||||||||||||||||||||||||
v.8  2378  CAAAACATAAGGGTTCAAGCCTCTCAACCCAAGGAAATGATTATAAAGTG  2427

v.1  2515  ggagcctttgaaatccatggagcagaatggaccaggcctagagtacagag  2564
           ||||||||||||||||||||||||||||||||||||||||||||||||||
v.8  2428  GGAGCCTTTGAAATCCATGGAGCAGAATGGACCAGGCCTAGAGTACAGAG  2477

v.1  2565  tgacctggaagccacagggagccccagtggagtgggaagaagaaacagtc  2614
           ||||||||||||||||||||||||||||||||||||||||||||||||||
v.8  2478  TGACCTGGAAGCCACAGGGAGCCCCAGTGGAGTGGGAAGAAGAAACAGTC  2527

v.1  2615  acaaaccacacattgcgggtgatgacgcctgctgtctatgccccttatga  2664
           ||||||||||||||||||||||||||||||||||||||||||||||||||
v.8  2528  ACAAACCACACATTGCGGGTGATGACGCCTGCTGTCTATGCCCCTTATGA  2577

v.1  2665  tgtcaaggtccaggctatcaatcaactaggatctgggcctgaccctcagt  2714
           ||||||||||||||||||||||||||||||||||||||||||||||||||
v.8  2578  TGTCAAGGTCCAGGCTATCAATCAACTAGGATCTGGGCCTGACCCTCAGT  2627

v.1  2715  cagtgactctctattctggagaagactatcctgatacagctccagtgatc  2764
           ||||||||||||||||||||||||||||||||||||||||||||||||||
v.8  2628  CAGTGACTCTCTATTCTGGAGAAGACTATCCTGATACAGCTCCAGTGATC  2677

v.1  2765  catggggtggacgttataaacagtacattagttaaagttacctggtcaac  2814
           ||||||||||||||||||||||||||||||||||||||||||||||||||
v.8  2678  CATGGGGTGGACGTTATAAACAGTACATTAGTTAAAGTTACCTGGTCAAC  2727

v.1  2815  agttccaaaggacagagtacatggacgtctgaaaggctatcagataaatt  2864
           ||||||||||||||||||||||||||||||||||||||||||||||||||
v.8  2728  AGTTCCAAAGGACAGAGTACATGGACGTCTGAAAGGCTATCAGATAAATT  2777
```

TABLE LIIIg-continued

Nucleotide seguence alignment of 282P1G03 v.1 (SEQ ID NO: 188) and 282P1G03 v.8 (SEQ ID NO: 189)

| | | | |
|---|---|---|---|
| v.1 | 2865 | ggtggaaaacaaaaagtctgttggatggaagaacacatcccaaagaagtg | 2914 |
| v.8 | 2778 | GGTGGAAAACAAAAAGTCTGTTGGATGGAAGAACACATCCCAAAGAAGTG | 2827 |
| v.1 | 2915 | aacattctaagattttcaggacaaagaaactctggaatggttccttcctt | 2964 |
| v.8 | 2828 | AACATTCTAAGATTTTCAGGACAAAGAAACTCTGGAATGGTTCCTTCCTT | 2877 |
| v.1 | 2965 | agatgcctttagtgaatttcatttaacagtcttagcctataactctaaag | 3014 |
| v.8 | 2878 | AGATGCCTTTAGTGAATTTCATTTAACAGTCTTAGCCTATAACTCTAAAG | 2927 |
| v.1 | 3015 | gagctggtcctgaaagtgagccttatatatttcaaacaccagaaggagta | 3064 |
| v.8 | 2928 | GAGCTGGTCCTGAAAGTGAGCCTTATATATTTCAAACACCAGAAGGAGTA | 2977 |
| v.1 | 3065 | cctgaacagccaacttttctaaaggtcatcaaagttgataaagacactgc | 3114 |
| v.8 | 2978 | CCTGAACAGCCAACTTTTCTAAAGGTCATCAAAGTTGATAAAGACACTGC | 3027 |
| v.1 | 3115 | cactttatcttggggactacctaagaaattaaatggaaacttaactggct | 3164 |
| v.8 | 3028 | CACTTTATCTTGGGGACTACCTAAGAAATTAAATGGAAACTTAACTGGCT | 3077 |
| v.1 | 3165 | atcttttgcaatatcagataataaatgacacctacgagattggagaatta | 3214 |
| v.8 | 3078 | ATCTTTTGCAATATCAGATAATAAATGACACCTACGAGATTGGAGAATTA | 3127 |
| v.1 | 3215 | aatgatattaacattacaactccatcaaagcccagctggcacctctcaaa | 3264 |
| v.8 | 3128 | AATGATATTAACATTACAACTCCATCAAAGCCCAGCTGGCACCTCTCAAA | 3177 |
| v.1 | 3265 | cctgaatgcaactaccaagtacaaattctacttgagggcttgcacttcac | 3314 |
| v.8 | 3178 | CCTGAATGCAACTACCAAGTACAAATTCTACTTGAGGGCTTGCACTTCAC | 3227 |
| v.1 | 3315 | agggctgtggaaaaccgatcacggaggaaagctccaccttaggagaaggg | 3364 |
| v.8 | 3228 | AGGGCTGTGGAAAACCGATCACGGAGGAAAGCTCCACCTTAGGAGAAGGG | 3277 |
| v.1 | 3365 | agtaaaggtatcgggaagatatcaggagtaaatcttactcaaaagactca | 3414 |
| v.8 | 3278 | AGTAAAGGTATCGGGAAGATATCAGGAGTAAATCTTACTCAAAAGACTCA | 3327 |
| v.1 | 3415 | cccaatagaggtatttgagccgggagctgaacatatagttcgcctaatga | 3464 |
| v.8 | 3328 | CCCAATAGAGGTATTTGAGCCGGGAGCTGAACATATAGTTCGCCTAATGA | 3377 |
| v.1 | 3465 | ctaagaattggggcgataacgatagcatttttcaagatgtaattgagaca | 3514 |
| v.8 | 3378 | CTAAGAATTGGGGCGATAACGATAGCATTTTTCAAGATGTAATTGAGACA | 3427 |
| v.1 | 3515 | agagggagagaatatgctggtttatatgatgacatctccactcaaggctg | 3564 |
| v.8 | 3428 | AGAGGGAGAGAATATGCTGGTTTATATGATGACATCTCCACTCAAGGCTG | 3477 |
| v.1 | 3565 | gtttattggactgatgtgtgcgattgctcttctcacactactattattaa | 3614 |
| v.8 | 3478 | GTTTATTGGACTGATGTGTGCGATTGCTCTTCTCACACTACTATTATTAA | 3527 |
| v.1 | 3615 | ctgtttgctttgtgaagaggaatagaggtggaaagtactcagttaaagaa | 3664 |
| v.8 | 3528 | CTGTTTGCTTTGTGAAGAGGAATAGAGGTGGAAAGTACTCAGTTAAAGAA | 3577 |
| v.1 | 3665 | aaggaagatttgcatccagacccagaaattcagtcagtaaaagatgaaac | 3714 |
| v.8 | 3578 | AAGGAAGATTTGCATCCAGACCCAGAAATTCAGTCAGTAAAAGATGAAAC | 3627 |
| v.1 | 3715 | ctttggtgaatacagtgacagtgatgaaaagcctctcaaaggaagccttc | 3764 |
| v.8 | 3628 | CTTTGGTGAATACAGTGACAGTGATGAAAAGCCTCTCAAAGGAAGCCTTC | 3677 |
| v.1 | 3765 | ggtcccttaatagggatatgcagcctactgaaagtgctgacagcttagtc | 3814 |
| v.8 | 3678 | GGTCCCTTAATAGGGATATGCAGCCTACTGAAAGTGCTGACAGCTTAGTC | 3727 |

TABLE LIIIg-continued

Nucleotide sequence alignment of 282P1G03 v.1 (SEQ ID NO: 188) and 282P1G03 v.8 (SEQ ID NO: 189)

```
v.1  3815  gaatacggagagggagaccatggtctcttcagtgaagatggatcatttat  3864
           ||||||||||||||||||||||||||||||||||||||||||||||||||
v.8  3728  GAATACGGAGAGGGAGACCATGGTCTCTTCAGTGAAGATGGATCATTTAT  3777

v.1  3865  tggtgcctacgctggatctaaggagaagggatctgttgaaagcaatggaa  3914
           ||||||||||||||||||||||||||||||||||||||||||||||||||
v.8  3778  TGGTGCCTACGCTGGATCTAAGGAGAAGGGATCTGTTGAAAGCAATGGAA  3827

v.1  3915  gttctacagcaacttttccccttcgggcataaacacaacatatgtaagca  3964
           ||||||||||||||||||||||||||||||||||||||||||||||||||
v.8  3828  GTTCTACAGCAACTTTTCCCCTTCGGGCATAAACACAACATATGTAAGCA  3877

v.1  3965  acgctactggttcaccccaaccttccatatttatctgttcaaaggagcaa  4014
           ||||||||||||||||||||||||||||||||||||||||||||||||||
v.8  3878  ACGCTACTGGTTCACCCCAACCTTCCATATTTATCTGTTCAAAGGAGCAA  3927

v.1  4015  gaactttcatataggaatagaaacatgctggccgaagatttcatccagaa  4064
           ||||||||||||||||||||||||||||||||||||||||||||||||||
v.8  3928  GAACTTTCATATAGGAATAGAAACATGCTGGCCGAAGATTTCATCCAGAA  3977

v.1  4065  gtcaacatcctgcaattatgttgaaaagagtagtactttcttcaaaatat  4114
           ||||||||||||||||||||||||||||||||||||||||||||||||||
v.8  3978  GTCAACATCCTGCAATTATGTTGAAAAGAGTAGTACTTTCTTCAAAATAT  4027

v.1  4115  aaaatgccaagcacttcaggcctatgttttgcttatattgttttcaggtg  4164
           ||||||||||||||||||||||||||||||||||||||||||||||||||
v.8  4028  AAAATGCCAAGCACTTCAGGCCTATGTTTTGCTTATATTGTTTTCAGGTG  4077

v.1  4165  ctcaaaatgcaaaacacaaaacaaatcctgcatttagatacacctcaact  4214
           ||||||||||||||||||||||||||||||||||||||||||||||||||
v.8  4078  CTCAAAATGCAAAACACAAAACAAATCCTGCATTTAGATACACCTCAACT  4127

v.1  4215  aaatccaaagtccccattcagtatattccatatttgcctgattttactat  4264
           ||||||||||||||||||||||||||||||||||||||||||||||||||
v.8  4128  AAATCCAAAGTCCCCATTCAGTATATTCCATATTTGCCTGATTTTACTAT  4177

v.1  4265  tcggtgtgtttgcatagatgttgctacttggtgggtttttctccgtatgc  4314
           ||||||||||||||||||||||||||||||||||||||||||||||||||
v.8  4178  TCGGTGTGTTTGCATAGATGTTGCTACTTGGTGGGTTTTTCTCCGTATGC  4227

v.1  4315  acattggtatacagtctctgagaactggcttggtgactttgcttcactac  4364
           ||||||||||||||||||||||||||||||||||||||||||||||||||
v.8  4228  ACATTGGTATACAGTCTCTGAGAACTGGCTTGGTGACTTTGCTTCACTAC  4277

v.1  4365  aggttaaaagaccataagcaaactggttatttaaaatgtaaaaaggaata  4414
           ||||||||||||||||||||||||||||||||||||||||||||||||||
v.8  4278  AGGTTAAAAGACCATAAGCAAACTGGTTATTTAAAATGTAAAAAGGAATA  4327

v.1  4415  tgaaagtcttattaaaacacttcattgaaaatatacagtctaaatttatt  4464
           ||||||||||||||||||||||||||||||||||||||||||||||||||
v.8  4328  TGAAAGTCTTATTAAAACACTTCATTGAAAATATACAGTCTAAATTTATT  4377

v.1  4465  atttaaattttactagcaaaagtcttaggtgaacaatcaactagtatttg  4514
           ||||||||||||||||||||||||||||||||||||||||||||||||||
v.8  4378  ATTTAAATTTTACTAGCAAAAGTCTTAGGTGAACAATCAACTAGTATTTG  4427

v.1  4515  ttgagctcctatttgcccagagatggtcatatttaaacagaagtatacgt  4564
           ||||||||||||||||||||||||||||||||||||||||||||||||||
v.8  4428  TTGAGCTCCTATTTGCCCAGAGATGGTCATATTTAAACAGAAGTATACGT  4477

v.1  4565  ttttcagtttcaacatgaatttttttatttctgtcagttatgacatccac  4614
           ||||||||||||||||||||||||||||||||||||||||||||||||||
v.8  4478  TTTTCAGTTTCAACATGAATTTTTTTATTTCTGTCAGTTATGACATCCAC  4527

v.1  4615  gagcatcactttttgtgtctgtttttttttttttcttggactaaattcaa  4664
           ||||||||||||||||||||||||||||||||||||||||||||||||||
v.8  4528  gAGCATCACTTTTTGTGTCTGTTTTTTTTTTTTTCTTGGACTAAATTCAA  4577

v.1  4665  ctgcatggaagcggtggtcagaaggttgttttatacgagaacaggcagaa  4714
           ||||||||||||||||||||||||||||||||||||||||||||||||||
v.8  4578  CTGCATGGAAGCGGTGGTCAGAAGGTTGTTTTATACGAGAACAGGCAGAA  4627

v.1  4715  agtgcccattgttcaggattctaatagctacatctacttaatatcttcat  4764
           ||||||||||||||||||||||||||||||||||||||||||||||||||
v.8  4628  AGTGCCCATTGTTCAGGATTCTAATAGCTACATCTACTTAATATCTTCAT  4677
```

TABLE LIIIg-continued

Nucleotide seguence alignment of 282P1G03 v.1 (SEQ ID NO: 188) and 282P1G03 v.8 (SEQ ID NO: 189)

```
v.1  4765  ttctaaattgactgcttttaccttttttctcatgtttatataatggtatgc  4814
           ||||||||||||||||||||||||||||||||||||||||||||||||||
v.8  4678  TTCTAAATTGACTGCTTTTACCTTTTTCTCATGTTTATATAATGGTATGC  4727

v.1  4815  ttgcatatatttcatgaatacattgtacatattatgttaatatttacaca  4864
           ||||||||||||||||||||||||||||||||||||||||||||||||||
v.8  4728  TTGCATATATTTCATGAATACATTGTACATATTATGTTAATATTTACACA  4777

v.1  4865  atttaaaatatagatgtgttttattttgaagtgagaaaatgaacattaac  4914
           ||||||||||||||||||||||||||||||||||||||||||||||||||
v.8  4778  ATTTAAAATATAGATGTGTTTTATTTTGAAGTGAGAAAATGAACATTAAC  4827

v.1  4915  aggcatgtttgtacagctagaatatattagtaagatactgtttttcgtca  4964
           ||||||||||||||||||||||||||||||||||||||||||||||||||
v.8  4828  AGGCATGTTTGTACAGCTAGAATATATTAGTAAGATACTGTTTTTCGTCA  4877

v.1  4965  ttccagagctacaactaataacacgaggttccaaagctgaagactttgta  5014
           ||||||||||||||||||||||||||||||||||||||||||||||||||
v.8  4878  TTCCAGAGCTACAACTAATAACACGAGGTTCCAAAGCTGAAGACTTTGTA  4927

v.1  5015  taaagtatttgggttttgttcttgtattgctttctttcaacagtttcaaa  5064
           ||||||||||||||||||||||||||||||||||||||||||||||||||
v.8  4928  TAAAGTATTTGGGTTTTGTTCTTGTATTGCTTTCTTTCAACAGTTTCAAA  4977

v.1  5065  ataaaatatcatacaaatattgagggaaatgttttcatatttttcaaaat  5114
           ||||||||||||||||||||||||||||||||||||||||||||||||||
v.8  4978  ATAAAATATCATAcAAATATTGAGGGAAATGTTTTCATATTTTTCAAAAT  5027

v.1  5115  aggtttttattgttgaatgtacatctaccccagcccctcaaaagaaaaac  5164
           ||||||||||||||||||||||||||||||||||||||||||||||||||
v.8  5028  AGGTTTTTATTGTTGAATGTACATCTACCCCAGCCCCTCAAAAGAAAAAC  5077

v.1  5165  tgtttacatagaaattcctacacatacgtttgcgtatatgttattttaaa  5214
           ||||||||||||||||||||||||||||||||||||||||||||||||||
v.8  5078  TGTTTACATAGAAATTCCTACACATACGTTTGCGTATATGTTATTTTAAA  5127

v.1  5215  catctttgtggtgagaatttttttccccgatattctccttctgtcaaagtc  5264
           ||||||||||||||||||||||||||||||||||||||||||||||||||
v.8  5128  CATCTTTGTGGTGAGAATTTTTTCCCCGATATTCTCCTTCTGTCAAAGTC  5177

v.1  5265  agaacaaattcagggaatttattttctggcagttgtgctccagtcctttt  5314
           ||||||||||||||||||||||||||||||||||||||||||||||||||
v.8  5178  AGAACAAATTCAGGGAATTTATTTTCTGGCAGTTGTGCTCCAGTCCTTTT  5227

v.1  5315  aaaattgtacatgaacatgttttagaaacaatatggaggatgatgcatac  5364
           ||||||||||||||||||||||||||||||||||||||||||||||||||
v.8  5228  AAAATTGTACATGAACATGTTTTAGAAACAATATGGAGGATGATGCATAC  5277

v.1  5365  atgtcggtcaagttcagcgctcgacattttatggaaagatttttttaacc  5414
           ||||||||||||||||||||||||||||||||||||||||||||||||||
v.8  5278  ATGTCGGTCAAGTTCAGCGCTCGACATTTTATGGAAAGATTTTTTTAACC  5327

v.1  5415  ttaccacgaaatacttaactactgtttaagtgaattgacttatttcactt  5464
           ||||||||||||||||||||||||||||||||||||||||||||||||||
v.8  5328  TTACCACGAAATACTTAACTACTGTTTAAGTGAATTGACTTATTTCACTT  5377

v.1  5465  tagtttttgaactgtgattattggtatactgttatatcctcaacttggat  5514
           ||||||||||||||||||||||||||||||||||||||||||||||||||
v.8  5378  TAGTTTTTGAACTGTGATTATTGGTATACTGTTATATCCTCAACTTGGAT  5427

v.1  5515  ttatggtaacccccttttagttcatggagaccaaaatttggggtatttata  5564
           ||||||||||||||||||||||||||||||||||||||||||||||||||
v.8  5428  TTATGGTAACCCCTTTTAGTTCATGGAGACCAAAATTTGGGGTATTTATA  5477

v.1  5565  atagtcagcgcaggaatgcacatggaatatctacttgtccttttgaacct  5614
           ||||||||||||||||||||||||||||||||||||||||||||||||||
v.8  5478  ATAGTCAGCGCAGGAATGCACATGGAATATCTACTTGTCCTTTTGAACCT  5527

v.1  5615  cacgagtcatccagaatgtatagacaggaaaagcatgtcttatttaaaac  5664
           ||||||||||||||||||||||||||||||||||||||||||||||||||
v.8  5528  CACGAGTCATCCAGAATGTATAGACAGGAAAAGCATGTCTTATTTAAAAC  5577

v.1  5665  tgtaatttatgggctcaggatctgaccgcagtcccgggagtaagcatttc  5714

v.8  5578  TGTAATTTATGGGCTCAGGATCTGACCGCAGTCCCGGGAGTAAGCATTTC  5627
```

TABLE LIIIg-continued

Nucleotide seguence alignment of 282P1G03 v.1 (SEQ ID NO: 188) and 282P1G03 v.8 (SEQ ID NO: 189)

| | | | |
|---|---|---|---|
| v.1 | 5715 | aaaggggaaggcagtgtggtccctaccctgtgtgaatgtgaggatgtag | 5764 |
| v.8 | 5628 | AAAGGGGAAGGCAGTGTGGTCCCTACCCTGTGTGAATGTGAGGATGTAG | 5677 |
| v.1 | 5765 | acatccatcagtgcaactcgagctccatcctcctccgatttctaaggctc | 5814 |
| v.8 | 5678 | ACATCCATCAGTGCAACTCGAGCTCCATCCTCCTCCGATTTCTAAGGCTC | 5727 |
| v.1 | 5815 | cagttttctggagggacagtcatcatgttttgatttatctgggagaaaac | 5864 |
| v.8 | 5728 | CAGTTTTCTGGAGGGACAGTCATCATGTTTTGATTTATCTGGGAGAAAAC | 5777 |
| v.1 | 5865 | tgtggtgcacagcttgtgaggagggcaaggttgtgacgttcgagcttagt | 5914 |
| v.8 | 5778 | TGTGGTGCACAGCTTGTGAGGAGGGCAAGGTTGTGACGTTCGAGCTTAGT | 5827 |
| v.1 | 5915 | tctggtgttattctgtctcctcttctttgtcatcagccaaaacgtggttt | 5964 |
| v.8 | 5828 | TCTGGTGTTATTCTGTCTCCTCTTCTTTGTCATCAGCCAAAACGTGGTTT | 5877 |
| v.1 | 5965 | ttaaagagagtcatgcaggttagaaataatgtcaaaaatatttaggaatt | 6014 |
| v.8 | 5878 | TTAAAGAGAGTCATGCAGGTTAGAAATAATGTCAAAAATATTTAGGAATT | 5927 |
| v.1 | 6015 | taataacctttaagtcagaaactaaaacaaatactgaaatattagctctt | 6064 |
| v.8 | 5928 | TAATAACCTTTAAGTCAGAAACTAAAACAAATACTGAAATATTAGCTCTT | 5977 |
| v.1 | 6065 | cctacacttcgtgttcccctttagctgcctgaaaatcaagattgctccta | 6114 |
| v.8 | 5978 | CCTACACTTCGTGTTCCCCTTTAGCTGCCTGAAAATCAAGATTGCTCCTA | 6027 |
| v.1 | 6115 | ctcagatcttctgagtggctaaaacttatggatatgaaaaatgagattga | 6164 |
| v.8 | 6028 | CTCAGATCTTCTGAGTGGCTAAAACTTATGGATATGAAAAATGAGATTGA | 6077 |
| v.1 | 6165 | atgatgactatgctttgctatcattgttacctttcctcaatactatttgg | 6214 |
| v.8 | 6078 | ATGATGACTATGCTTTGCTATCATTGTTACCTTTCCTCAATACTATTTGG | 6127 |
| v.1 | 6215 | caactactgggactcttcagcacaaaaggaatagatctatgattgaccct | 6264 |
| v.8 | 6128 | CAACTACTGGGACTCTTCAGCACAAAAGGAATAGATCTATGATTGACCCT | 6177 |
| v.1 | 6265 | gattttaattgtgaaattatatgattcatatattttatgaatcagaataa | 6314 |
| v.8 | 6178 | GATTTTAATTGTGAAATTATATGATTCATATATTTTATGAATCAGAATAA | 6227 |
| v.1 | 6315 | ccttcaaataaaataaatctaagtcggttaaaatggatttcatgattttc | 6364 |
| v.8 | 6228 | CCTTCAAATAAAATAAATCTAAGTCGGTTAAAATGGATTTCATGATTTTC | 6277 |
| v.1 | 6365 | cctcagaaaatgagtaacggagtocaoggcgtgcaatggtaattataaat | 6414 |
| v.8 | 6278 | CCTCAGAAAATGAGTAACgGAGTCCACGGCGTGCAATGGTAATTATAAAT | 6327 |
| v.1 | 6415 | tggtgatgcttgtttgcaaattgcccactcgtgataagtcaacagccaat | 6464 |
| v.8 | 6328 | TGGTGATGCTTGTTTGCAAATTGCCCACTCGTGATAAGTCAACAGCCAAT | 6377 |
| v.1 | 6465 | atttaaaactttgttcgttactggctttaccctaactttctctagtctac | 6514 |
| v.8 | 6378 | ATTTAAAACTTTGTTCGTTACTGGCTTTACCCTAACTTTCTCTAGTCTAC | 6427 |
| v.1 | 6515 | tgtcaatatcattttaatgtaattgattgtatatagtctcaagaatggtt | 6564 |
| v.8 | 6428 | TGTCAATATCATTTTAATGTAATTGATTGTATATAGTCTCAAGAATGGTT | 6477 |
| v.1 | 6565 | ggtgggcatgagttcctagagaactgtccaagggttgggaaaatccaaat | 6614 |
| v.8 | 6478 | GGTGGGCATGAGTTCCTAGAGAACTGTCCAAGGGTTGGGAAAATCCAAAT | 6527 |
| v.1 | 6615 | tctcttcctggctccagcactgattttgtacataaacattaggcaggttg | 6664 |
| v.8 | 6528 | TCTCTTCCTGGCTCCAGCACTGATTTTGTACATAAACATTAGGCAGGTTG | 6577 |

TABLE LIIIg-continued

Nucleotide seguence alignment of 282P1G03 v.1 (SEQ ID NO: 188) and 282P1G03 v.8 (SEQ ID NO: 189)

```
v.1  6665  cttaaccttttatttcaaactctctcaactctaaagtgctaataataat  6714
v.8  6578  CTTAACCTTTTATTTCAAACTCTCTCAACTCTAAAGTGCTAATAATAAT  6627

v.1  6715  ctcagttaccttatctttgtcacagggtgttctttttatgaagaaaaat  6764
v.8  6628  CTCAGTTACCTTATCTTTGTCACAGGGTGTTCTTTTTATGAAGAAAAAT  6677

v.1  6765  ttgaaaatgataaaagctaagatgccttctaacttcataagcaaacettt  6814
v.8  6678  TTGAAAATGATAAAAGCTAAGATGCCTTCTAACTTCATAAGCAAACCTTT  6727

v.1  6815  aactaattatgtatctgaaagtcacccccacataccaactcaactttttt  6864
v.8  6728  AACTAATTATGTATCTGAAAGTCACCCCCACATACCAACTCAACTTTTTT  6777

v.1  6865  cctgtgaacacataaatatatttttatagaaaaacaaatctacataaaat  6914
v.8  6778  CCTGTGAACACATAAATATATTTTTATAGAAAAACAAATCTACATAAAAT  6827

v.1  6915  aaatctactgtttagtgagcagtatgacttgtacatgccattgaaaatta  6964
v.8  6828  AAATCTACTGTTTAGTGAGCAGTATGACTTGTACATGCCATTGAAAATTA  6877

v.1  6965  ttaatcagaagaaaattaagcagggtctttgctatacaaaagtgttttcc  7014
v.8  6878  TTAATCAGAAGAAAATTAAGCAGGGTCTTTGCTATACAAAAGTGTTTTCC  6927

v.1  7015  actaattttgcatgcgtatttataagaaaaatgtgaatttggtggtttta  7064
v.8  6928  ACTAATTTTGCATGCGTATTTATAAGAAAAATGTGAATTTGGTGGTTTTA  6977

v.1  7065  ttctatcggtataaaggcatcgatattttagatgcacccgtgtttgtaaa  7114
v.8  6978  TTCTATCGGTATAAAGGCATCGATATTTTAGATGCACCCGTGTTTGTAAA  7027

v.1  7115  aatgtagagcacaatggaattatgctggaagtctcaaataatatttttt  7164
v.8  7028  AATGTAGAGCACAATGGAATTATGCTGGAAGTCTCAAATAATATTTTTT  7077

v.1  7165  cctattttatactcatggaagagataagctaaagaggggacaataatgag  7214
v.8  7078  CCTATTTTATACTCATGGAAGAGATAAGCTAAAGAGGGGACAATAATGAG  7127

v.1  7215  aaatgttggtgtgcttttctaagcatttaaaacataattgccaattgaaa  7264
v.8  7128  AAATGTTGGTGTGCTTTTCTAAGCATTTAAAACATAATTGCCAATTGAAA  7177

v.1  7265  ccctaaatatgtttacataccattaagatatgattcatgtaacaatgtta  7314
v.8  7178  CCCTAAATATGTTTACATACCATTAAGATATGATTCATGTAACAATGTTA  7227

v.1  7315  aattaattataatgggattgggtttgttatctgtggtagtatatatccta  7364
v.8  7228  AATTAATTATAATGGGATTGCGTTTGTTATCTGTGGTAGTATATATCCTA  7277

v.1  7365  gtgttcctatagtgaaataagtagggttcagccaaagctttctttgtttt  7414
v.8  7278  GTGTTCCTATAGTGAAATAAGTAGGGTTCAGCCAAAGCTTTCTTTGTTTT  7327

v.1  7415  gtaccttaaattgttcgattacgtcatcaaaagagatgaaaggtatgtag  7464
v.8  7328  GTACCTTAAATTGTTCCATTACGTCATCAAAAGAGATGAAAGGTATGTAG  7377

v.1  7465  aacaggttcacgtgattaccttttttcttttggcttggattaatattcata  7514
v.8  7378  AACAGGTTCACGTGATTACCTTTTTCTTTTGGCTTGGATTAATATTCATA  7427

v.1  7515  gtagaactttataaaacgtgtttgtattgtaggtggtgtttgtattatgc  7564
v.8  7428  GTAGAACTTTATAAAACGTGTTTGTATTGTAGGTGGTGTTTGTATTATGC  7477

v.1  7565  ttatgactatgtatggtttgaaaatattttcattatacatgaaattcaac  7614
v.8  7478  TTATGACTATGTATGGTTTGAAAATATTTTCATTATACATGAAATTCAAC  7527
```

TABLE LIIIg-continued

Nucleotide sequence alignment of 282P1G03 v.1 (SEQ ID NO: 188) and 282P1G03 v.8 (SEQ ID NO: 189)

```
v.1  7615  tttccaaataaaagttctacttcatgtaatccaaaa 7650
           ||||||||||||||||||||||||||||||||||||
v.8  7528  TTTCCAAATAAAAGTTCTACTTCATGTAATCCAAAA 7563
```

TABLE LIVg

Peptide sequences of protein coded by 282P1G03 v.8

```
                                                     (SEQ ID NO:190)
MEPLLLGRGL IVYLMFLLLK FSKAIEIPSS VQQVPTIIKQ SKVQVAFPFD EYFQIECEAK  60
GNPEPTFSWT KDGNPFYFTD HRIIPSNNSG TFRIPNEGHI SHFQGKYRCF ASNKLGIAMS  120
EEIEFIVPKL EHIEQDERVY MSQKGDLYFA NVEEKDSRND YCCFAAFPRL RTIVQKMPMK  180
LTVNSLKHAN DSSSSTEIGS KANSIKQRKP KLLLPPTESG SESSITILKO EILLLECFAE  240
GLPTPQVDWN KIGGDLPKGR ETKENYGKTL KIENVSYQDK GNYRCTASNF LGTATHDFHV  300
IVEDNISHEL FTLHPEPPRW TKKPQSAVYS TGSNGILLCE AEGEPQPTIK WRVNGSPVDN  360
HPFAGDVVFP RETSFTNLQP NHTAVYQCEA SNVHGTILAN ANIDVVDVRP LIQTKDGENY  420
ATVVGYSAFL HCEFFASPEA VVSWQKVEEV KPLEGRRYHI YENGTLQINR TTEEDAGSYS  480
CWVENAIGKT AVTANLDIRN ATKLRVSPKN PRIPKLHMLE LHCESKCDSH LKHSLKLSWS  540
KDGEAFEING TEDGRIIIDG ANLTISNVTL EDQGIYCCSA HTALDSAADI TQVTVLDVPD  600
PPENLHLSER QNRSVRLTWE AGADHNSNIS EYIVEFEGNK EEPGRWEELT RVQGKKTTVI  660
LPLAPFVRYQ FRVIAVNEVG RSQPSQPSDH HETPPAAPDR NPQNIRVQAS QPKEMIIKWE  720
PLKSMEQNGP GLEYRVTWKP QGAPVEWEEE TVTNHTLRVM TPAVYAPYDV KVQAINQLGS  780
GPDPQSVTLY SGEDYPDTAP VIHGVDVINS TLVKVTWSTV PKDRVHGRLK GYQINWWKTK  840
SLLDGRTHPK EVNILRFSGQ RNSGMVPSLD AFSEFHLTVL AYNSKGAGPE SEPYIFQTPE  900
GVPEQPTFLK VIKVDKDTAT LSWGLPKKLN GNLTGYLLQY QIINDTYEIG ELNDINITTP  960
SKPSWHLSNL NATTKYKFYL RACTSQGCGK PITEESSTLG EGSKGIGKIS GVNLTQKTHP  1020
IEVFEPGAEH IVRLMTKNWG DNDSIFQDVI ETRGREYAGL YDDISTQGWF IGLMCAIALL  1080
TLLLLTVCFV KRNRGGKYSV KEKEDLHPDP EIQSVKDETF GEYSDSDEKP LKGSLRSLNR  1140
DMQPTESADS LVEYGEGDHG LFSEDGSFIG AYAGSKEKGS VESNGSSTAT FPLRA 1195
```

TABLE LVg

Amino acid sequence alignment of 282P1G03 v.1 (SEQ ID NO: 191) and 282P1G03 v.8 (SEQ ID NO: 192)

```
v.1     1  MEPLLLGRGLIVYLMFLLLKFSKAIEIPSSVQQVPTIIKQSKVQVAFPFD  50
           ||||||||||||||||||||||||||||||||||||||||||||||||||
v.8     1  MEPLLLGRGLIVYLMFLLLKFSKAIEIPSSVQQVPTIIKQSKVQVAFPFD  50

v.1    51  EYFQTECEAKGNPEPTFSWTKDGNPFYFTDHRIIPSNNSGTFRIPNEGHI  100
           ||||||||||||||||||||||||||||||||||||||||||||||||||
v.8    51  EYFQIECEAKGNPEPTFSWTKDGNPFYFTDHRIIPSNNSGTFRIPNEGHI  100

v.1   101  SHFQGKYRCFASNKLGIAMSEEIEFIVPSVPKLPKEKIDPLEVEEGDPIV  150
           ||||||||||||||||||||||||||||
v.8   101  SHFQGKYRCFASNKLGIAIVISEEIEFIVP--------------------  128

v.1   151  LPCNPPKGLPPLHIYWMNIELEHIEQDERVYMSQKGDLYFANVEEKDSRN  200
                                 :|||||||||||||||||||||||||||||
v.8   129  -------------------KLEHIEQDERVYMSQKGDLYFANVEEKDSRN  159

v.1   201  DYCCFAAFPRLRTIVQKMPMKLTVNSLKHANDSSSSTEIGSKANSIKQRK  250
```

TABLE LVg-continued

Amino acid sequence alignment of 282P1G03 v.1 (SEQ ID NO: 191) and 282P1G03 v.8 (SEQ ID NO: 192)

```
              ||||||||||||||||||||||||||||||||||||||||||||||||||
v.8    160    DYCCFAAFPRLRTIVQKMPMKLTVNSLKHANDSSSSTEIGSKANSIKQRK  209

v.1    251    PKLLLPPTESGSESSITILKGEILLLECFAEGLPTPQVDWNKIGGDLPKG  300
              ||||||||||||||||||||||||||||||||||||||||||||||||||
v.8    210    PKLLLPPTESGSESSITILKGEILLLECFAEGLPTPQVDWNKIGGDLPKG  259

v.1    301    RETKENYGKTLKIENVSYQDKGNYRCTASNFLGTATHDFHVIVE------  344
              ||||||||||||||||||||||||||||||||||||||||||||
v.8    260    RETKENYGKTLKIENVSYQDKGNYRCTASNFLGTATHDFHVIVEDNISHE  309

v.1    345    ------EPPRWTKKPQSAVYSTGSNGILLCEAEGEPQPTIKWRVNGSPVD  388
                    ||||||||||||||||||||||||||||||||||||||||||||
v.8    310    LFTLHPEPPRWTKKPQSAVYSTGSNGILLCEAEGEPQPTIKWRVNGSPVD  359

v.1    389    NHPFAGDVVFPREISFTNLQPNHTAVYQCEASNVHGTILANANIDVVDVR  438
              ||||||||||||||||||||||||||||||||||||||||||||||||||
v.8    360    NHPFAGDVVFPREISFTNLQPNHTAVYQCEASNVHGTILANANIDVVDVR  409

v.1    439    PLIQTKDGENYATX1VGYSAFLHCEFFASPEAVVSWQKVEEVKPLEGRRYH 488
              ||||||||||||||||||||||||||||||||||||||||||||||||||
v.8    410    PLIQTKDGENYATVVGYSAFLHCEFFASPEAVVSWQKVEEVKPLEGRRYH  459

v.1    489    IYENGTLQINRTTEEDAGSYSCWVENAIGKTAVTANLDIRNATKLRVSPK  538
              ||||||||||||||||||||||||||||||||||||||||||||||||||
v.8    460    IYEMGTLQINRTTEEDAGSYSCWVENAIGKTAVTANLDIRNATKLRVSPK  509

v.1    539    NPRIPKLHMLELHCESKCDSHLKHSLKLSWSKDGEAFEINGTEDGRIIID  588
              ||||||||||||||||||||||||||||||||||||||||||||||||||
v.8    510    NPRIPKLHMLELHCESKCDSHLKHSLKLSWSKDGEAFEINGTEDGRIIID  559

v.1    589    GANLTISNVTLEDQGIYCCSAHTALDSAADITQVTVLDVPDPPENLHLSE  638
              ||||||||||||||||||||||||||||||||||||||||||||||||||
v.8    560    GANLTISNVTLEDQGIYCCSAHTALDSAADITQVTVLDVPDPPENLHLSE  609

v.1    639    RQNRSVRLTWEAGADHNSNISEYIVEFEGNKEEPGRWEELTRVQQKKTTV  688
              ||||||||||||||||||||||||||||||||||||||||||||||||||
v.8    610    RQNRSVRLTWEAGADHNSNISEYIVEFEGNKEEPGRWEELTRVQGKKTTV  659

v.1    689    ILPLAPFVRYQFRVIAVNEVGRSQPSQPSDHHETPPAAPDRNPQNIRVQA  738
              ||||||||||||||||||||||||||||||||||||||||||||||||||
v.8    660    ILPLAPFVRYQFRVIAVNEVGRSQPSQPSDHHETPPAAPDRNPQNIRVQA  709

v.1    739    SQPKEMIIKWEPLKSMEQNGPGLEYRVTWKPQGAPVEWEEETVTNHTLRV  788
              ||||||||||||||||||||||||||||||||||||||||||||||||||
v.8    710    SQPKEMIIKWEPLKSMEQNGPGLEYRVTWKPQGAPVEWEEETVTNHTLRV  759

v.1    789    MTPAVYAPYDVKVQAINQLGSGPDPQSVTLYSGEDYPDTAPVIHGVDVII  838
              ||||||||||||||||||||||||||||||||||||||||||||||||||
v.8    760    MTPAVYAPYDVKVQAINQLGSGPDPQSVTLYSGEDYPDTAPVIHGVDVIN  809

v.1    839    STLVKVTWSTVPKDRVHGRLKGYQINWWKTKSLLDGRTHPKEVNILRFSG  888
              ||||||||||||||||||||||||||||||||||||||||||||||||||
v.8    810    STLVKVTWSTVPKDRVHGRLKGYQINWWKTKSLLDGRTHPKEVNILRFSG  859

v.1    889    QRNSGMVPSLDAFSEFHLTVLAYNSKGAGPESEPYIFQTPEGVPEQPTFL  938
              ||||||||||||||||||||||||||||||||||||||||||||||||||
v.8    860    QRNSGMVPSLDAFSEFHLTVLAYNSKGAGPESEPYIFQTPEGVPEQPTFL  909

v.1    939    KVIKVDKDTATLSWGLPKKLMGNLTGYLLQYQIINDTYEIGELNDIMITT  988
              ||||||||||||||||||||||||||||||||||||||||||||||||||
v.8    910    KVIKVDKDTATLSWGLPKKLNGNLTGYLLQYQIINDTYEIGELNDIMITT  959

v.1    989    PSKPSWHLSNLNATTKYKFYLRACTSQGCGKPITEESSTLGEGSKGIGKI  1038
              ||||||||||||||||||||||||||||||||||||||||||||||||||
v.8    960    PSKPSWHLSNLNATTKYKFYLRACTSQGCGKPITEESSTLGEGSKGIGKI  1009

v.1   1039    SGVNLTQKTHPIEVFEPGAEHIVRLMTKNWGDNDSIFQDVIETRGREYAG  1088
              ||||||||||||||||||||||||||||||||||||||||||||||||||
v.8   1010    SGVNLTQKTHPIEVFEPGAEHIVRLMTKNWGDNDSIFQDVIETRGREYAG  1059

v.1   1089    LYDDISTQGWFIGLMCAIALLTLLLLTVCFVKRNRGGKYSVKEKEDLHPD  1138
              ||||||||||||||||||||||||||||||||||||||||||||||||||
v.8   1060    LYDDISTQGWFIGLMCAIALLTLLLLTVCFVKRNRGGKYSVKEKEDLHPD  1109

v.1   1139    PEIQSVKDETFGEYSDSDEKPLKGSLRSLNRDMQPTESADSLVEYGEGDH  1188
```

TABLE LVg-continued

Amino acid sequence alignment of 282P1G03 v.1 (SEQ ID NO: 191) and 282P1G03 v.8 (SEQ ID NO: 192)

```
          ||||||||||||||||||||||||||||||||||||||||||||||||||
v.8  1110 PEIQSVKDETFGEYSDSDEKPLKGSLRSLNRDMQPTESADSLVEYGEGDH  1159

v.1  1189 GLFSEDGSFIGAYAGSKEKGSVESNGSSTATFPLRA 1224
          ||||||||||||||||||||||||||||||||||||
v.8  1160 GLFSEDGSFTGAYAGSKEKGSVESNGSSTATFPLRA 1195
```

TABLE LIlh

Nucleotide sequence of 282P1G03 v.2

(SEQ ID NO:193)

```
cggaccctgc gcgcccccgt cccggctccc ggccggctcg ggggagaagg cgcccgaggg  60
gaggcgccgg acagatcgcg tttcggaggc ggcgcagttt ccaggttaac taaggtctca  120
gctgtaaacc aaaagtgaga ggagacatta agattttcat tcttaccggg ttgtcttctt  180
cctgaagagc aatggagccg cttttacttg gaagaggact aatcgtatat ctaatgttcc  240
tcctgttaaa attctcaaaa gcaattgaaa taccatcttc agttcaacag gttccaacaa  300
tcataaaaca gtcaaaagtc caagttgcct ttcccttcga tgagtatttt caaattgaat  360
gtgaagctaa aggaaatcca gaaccaacat tttcgtggac taaggatggc aacccttttt  420
atttcactga ccatcggata attccatcga acaattcagg aacattcagg atcccaaacg  480
aggggcacat atctcacttt caagggaaat accgctgctt tgcttcaaat aaactgggaa  540
tcgctatgtc agaagaaata gaatttatag ttccaagtgt tccaaaactc ccaaaagaaa  600
aaattgaccc tcttgaagtg gaggagggag atccaattgt cctcccatgc aatcctccca  660
aaggcctccc acctttacac atttattgga tgaatattga attagaacac atcgaacaag  720
atgaaagagt atacatgagc caaaagggag atctatactt cgcaaacgtg gaagaaaagg  780
acagtcgcaa tgactactgt tgctttgctg catttccaag attaaggact attgtacaga  840
aaatgccaat gaaactaaca gttaacagtt taaagcatgc taatgactca agttcatcca  900
cagaaattgg ttccaaggca aattccatca agcaaagaaa acccaaactg ctgttgcctc  960
ccactgagag tggcagtgag tcttcaatta ccatcctcaa aggggaaatc ttgctgcttg  1020
agtgttttgc tgaaggcttg ccaactccac aggttgattg gaacaaaatt ggtggtgact  1080
taccaaaggg gagagaaaca aaagaaaatt atggcaagac tttgaagata gagaatgtct  1140
cctaccagga caaaggaaat tatcgctgca cagccagcaa tttcttggga acagccactc  1200
acgattttca cgttatagta gaagagcctc ctcgctggac aaagaagcct cagagtgctg  1260
tgtatagcac cggaagcaat ggcatcttgt tatgtgaggc tgaaggagaa cctcaaccca  1320
caatcaagtg gagagtcaat ggctccccag ttgacaatca tccatttgct ggtgatgttg  1380
tcttccccag ggaaatcagt tttaccaacc ttcaaccaaa tcatactgct gtgtaccagt  1440
gtgaagcctc aaatgtccat ggaactatcc ttgccaatgc caatattgat gttgtggatg  1500
tccgtccatt gatacaaacc aaagatggag aaaattacgc tacagtggtt gggtacagtg  1560
ctttcttaca ttgcgagttc tttgcttcac ctgaggcagt cgtgtcctgg cagaaggtgg  1620
aagaagtgaa acccctggag ggcaggcggt atcatatcta tgaaaatggc acattgcaga  1680
tcaacagaac caccgaagaa gatgctgggt cttactcatg ttgggtagaa aatgctatag  1740
gaaaaactgc agtcacagcc aatttggata ttagaaatgc tacaaaactt agagtttctc  1800
ctaagaatcc tcgtatcccc aaattgcata tgcttgaatt acattgtgaa agcaaatgtg  1860
```

TABLE LIIh-continued

| Nucleotide sequence of 282P1G03 v.2 |
|---|
| actcacattt gaaacacagt ttgaagttgt cctggagtaa agatggagaa gcctttgaaa 1920 |
| ttaatggcac agaagatggc aggataatta ttgatggagc taatttgacc atatctaatg 1980 |
| taactttaga ggaccaaggt atttactgct gttcagctca tactgctcta gacagtgctg 2040 |
| ccgatataac tcaagtaact gttcttgatg ttccggatcc accagaaaac cttcacttgt 2100 |
| ctgaaagaca gaacaggagt gttcggctga cctgggaagc tggagctgac cacaacagca 2160 |
| atattagcga gtatattgtt gaatttgaag gaaacaaaga agagcctgga aggtgggagg 2220 |
| aactgaccag agtccaagga aagaaaacca cagttatctt acctttggct ccatttgtga 2280 |
| gataccagtt cagggtcata gccgtgaacg aagtagggag aagtcagcct agccagccgt 2340 |
| cagaccatca tgaaacacca ccagcagctc cagataggaa tccacaaaac ataagggttc 2400 |
| aagcctctca acccaaggaa atgattataa agtgggagcc tttgaaatcc atggagcaga 2460 |
| atggaccagg cctagagtac agagtgacct ggaagccaca gggagcccca gtggagtggg 2520 |
| aagaagaaac agtcacaaac cacacattgc gggtgatgac gcctgctgtc tatgcccctt 2580 |
| atgatgtcaa ggtccaggct atcaatcaac taggatctgg gcctgaccct cagtcagtga 2640 |
| ctctctattc tggagaagac tatcctgata cagctccagt gatccatggg gtggacgtta 2700 |
| taaacagtac attagttaaa gttacctggt caacagttcc aaaggacaga gtacatggac 2760 |
| gtctgaaagg ctatcagata aattggtgga aaacaaaaag tctgttggat ggaagaacac 2820 |
| atcccaaaga agtgaacatt ctaagatttt caggacaaag aaactctgga atggttcctt 2880 |
| ccttagatgc ctttagtgaa tttcatttaa cagtcttagc ctataactct aaaggagctg 2940 |
| gtcctgaaag tgagccttat atatttcaaa caccagaagg agtacctgaa cagccaactt 3000 |
| ttctaaaggt catcaaagtt gataaagaca ctgccacttt atcttgggga ctacctaaga 3060 |
| aattaaatgg aaacttaact ggctatcttt tgcaatatca gataataaat gacacctacg 3120 |
| agattggaga attaaatgat attaacatta caactccatc aaagcccagc tggcacctct 3180 |
| caaacctgaa tgcaactacc aagtacaaat tctacttgag ggcttgcact tcacagggct 3240 |
| gtggaaaacc gatcacggag gaaagctcca ccttaggaga agggagtaaa ggtatcggga 3300 |
| agatatcagg agtaaatctt actcaaaaga ctcacccaat agaggtattt gagccgggag 3360 |
| ctgaacatat agttcgccta atgactaaga attggggcga taacgatagc atttttcaag 3420 |
| atgtaattga gacaagaggg agagaatatg ctggtttata tgatgacatc tccactcaag 3480 |
| gctggtttat tggactgatg tgtgcgattg ctcttctcac actactatta ttaactgttt 3540 |
| gctttgtgaa gaggaataga ggtggaaagt actcagttaa agaaaaggaa gatttgcatc 3600 |
| cagacccaga aattcagtca gtaaaagatg aaacctttgg tgaatacagt gacagtgatg 3660 |
| aaaagcctct caaaggaagc cttcggtccc ttaataggga tatgcagcct actgaaagtg 3720 |
| ctgacagctt agtcgaatac ggagagggag accatggtct cttcagtgaa gatggatcat 3780 |
| ttattggtgc ctacgctgga tctaaggaga agggatctgt tgaaagcaat ggaagttcta 3840 |
| cagcaacttt tccccttcgg gcataaacac aacatatgta agcaacgcta ctggttcacc 3900 |
| ccaaccttcc atatttatct gttcaaagga gcaagaactt tcatatagga atagaaacat 3960 |
| gctggccgaa gatttcatcc agaagtcaac atcctgcaat tatgttgaaa agagtagtac 4020 |
| tttcttcaaa atataaaatg ccaagcactt caggcctatg ttttgcttat attgttttca 4080 |
| ggtgctcaaa atgcaaaaca caaaacaaat cctgcattta gatacacctc aactaaatcc 4140 |

TABLE LIlh-continued

| Nucleotide sequence of 282P1G03 v.2 |
|---|
| aaagtcccca ttcagtatat tccatatttg cctgatttta ctattcggtg tgtttgcata 4200 |
| gatgttgcta cttggtgggt ttttctccgt atgcacattg gtatacagtc tctgagaact 4260 |
| ggcttggtga ctttgcttca ctacaggtta aaagaccata agcaaactgg ttatttaaaa 4320 |
| tgtaaaaagg aatatgaaag tcttattaaa acacttcatt gaaaatatac agtctaaatt 4380 |
| tattatttaa attttactag caaaagtctt aggtgaacaa tcaactagta tttgttgagc 4440 |
| tcctatttgc ccagagatgg tcatatttaa acagaagtat acgtttttca gtttcaacat 4500 |
| gaattttttt atttctgtca gttatgacat ccacgagcat cactttttgt gtctgttttt 4560 |
| tttttttct tggactaaat tcaactgcat ggaagcggtg gtcagaaggt tgttttatac 4620 |
| gagaacaggc agaaagtgcc cattgttcag gattctaata gctacatcta cttaatatct 4680 |
| tcatttctaa attgactgct tttacctttt tctcatgttt atataatggt atgcttgcat 4740 |
| atatttcatg aatacattgt acatattatg ttaatattta cacaatttaa aatatagatg 4800 |
| tgttttattt tgaagtgaga aaatgaacat taacaggcat gtttgtacag ctagaatata 4860 |
| ttagtaagat actgtttttc gtcattccag agctacaact aataacacga ggttccaaag 4920 |
| ctgaagactt tgtataaagt atttgggttt tgttcttgta ttgctttctt tcaacagttt 4980 |
| caaaataaaa tatcatacaa atattgaggg aaatgttttc atatttttca aaataggttt 5040 |
| ttattgttga atgtacatct accccagccc ctcaaaagaa aaactgttta catagaaatt 5100 |
| cctacacata cgtttgcgta tatgttattt taaacatctt tgtggtgaga atttttttccc 5160 |
| cgatattctc cttctgtcaa agtcagaaca aattcaggga atttattttc tggcagttgt 5220 |
| gctccagtcc ttttaaaatt gtacatgaac atgttttaga aacaatatgg aggatgatgc 5280 |
| atacatgtcg gtcaagttca gcgctcgaca ttttatggaa agattttttt aaccttacca 5340 |
| cgaaatactt aactactgtt taagtgaatt gacttatttc actttagttt ttgaactgtg 5400 |
| attattggta tactgttata tcctcaactt ggatttatgg taaccccttt tagttcatgg 5460 |
| agaccaaaat ttggggtatt tataatagtc agcgcaggaa tgcacatgga atatctactt 5520 |
| gtccttttga acctcacgag tcatccagaa tgtatagaca ggaaaagcat gtcttattta 5580 |
| aaactgtaat ttatgggctc aggatctgac cgcagtcccg ggagtaagca tttcaaaggg 5640 |
| ggaaggcagt gtggtcccta ccctgtgtga atgtgaggat gtagacatcc atcagtgcaa 5700 |
| ctcgagctcc atcctcctcc gatttctaag gctccagttt tctggaggga cagtcatcat 5760 |
| gttttgattt atctgggaga aaactgtggt gcacagcttg tgaggagggc aaggttgtga 5820 |
| cgttcgagct tagttctggt gttattctgt ctcctcttct ttgtcatcag ccaaaacgtg 5880 |
| gtttttaaag agagtcatgc aggttagaaa taatgtcaaa aatatttagg aatttaataa 5940 |
| cctttaagtc agaaactaaa acaaatactg aaatattagc tcttcctaca cttcgtgttc 6000 |
| ccctttagct gcctgaaaat caagattgct cctactcaga tcttctgagt ggctaaaact 6060 |
| tatggatatg aaaaatgaga ttgaatgatg actatgcttt gctatcattg ttacctttcc 6120 |
| tcaatactat ttggcaacta ctgggactct tcagcacaaa aggaatagat ctatgattga 6180 |
| ccctgatttt aattgtgaaa ttatatgatt catatatttt atgaatcaga ataaccttca 6240 |
| aataaaataa atctaagtcg gttaaaatgg atttcatgat tttccctcag aaaatgagta 6300 |
| acggagtcca cggcgtgcaa tggtaattat aaattggtga tgcttgtttg caaattgccc 6360 |
| actcgtgata agtcaacagc caatatttaa aactttgttc gttactggct ttaccctaac 6420 |
| tttctctagt ctactgtcaa tatcatttta atgtaattga ttgtatatag tctcaagaat 6480 |

TABLE LIIh-continued

| Nucleotide sequence of 282P1G03 v.2 |
| --- |
| ggttggtggg catgagttcc tagagaactg tccaagggtt gggaaaatcc aaattctctt 6540 |
| cctggctcca gcactgattt tgtacataaa cattaggcag gttgcttaac ctttttattt 6600 |
| caaactctct caactctaaa gtgctaataa taatctcagt taccttatct ttgtcacagg 6660 |
| gtgttctttt ttatgaagaa aaatttgaaa atgataaaag ctaagatgcc ttctaacttc 6720 |
| ataagcaaac ctttaactaa ttatgtatct gaaagtcacc cccacatacc aactcaactt 6780 |
| ttttcctgtg aacacataaa tatattttta tagaaaaaca aatctacata aaataaatct 6840 |
| actgtttagt gagcagtatg acttgtacat gccattgaaa attattaatc agaagaaaat 6900 |
| taagcagggt ctttgctata caaaagtgtt ttccactaat tttgcatgcg tatttataag 6960 |
| aaaaatgtga atttggtggt tttattctat cggtataaag gcatcgatat tttagatgca 7020 |
| cccgtgtttg taaaaatgta gagcacaatg gaattatgct ggaagtctca aataatattt 7080 |
| ttttcctatt ttatactcat ggaagagata agctaaagag gggacaataa tgagaaatgt 7140 |
| tggtgtgctt ttctaagcat ttaaaacata attgccaatt gaaaccctaa atatgtttac 7200 |
| ataccattaa gatatgattc atgtaacaat gttaaattaa ttataatggg attgggtttg 7260 |
| ttatctgtgg tagtatatat cctagtgttc ctatagtgaa ataagtaggg ttcagccaaa 7320 |
| gctttctttg ttttgtacct taaattgttc gattacgtca tcaaaagaga tgaaaggtat 7380 |
| gtagaacagg ttcacgtgat tacctttttc ttttggcttg gattaatatt catagtagaa 7440 |
| ctttataaaa cgtgtttgta ttgtaggtgg tgtttgtatt atgcttatga ctatgtatgg 7500 |
| tttgaaaata ttttcattat acatgaaatt caactttcca aataaaagtt ctacttcatg 7560 |
| taatccaaaa 7570 |

TABLE LIIIh

Nucleatide sequence alignment of 282P1G03 v.1 (SEQ ID NO: 194) and 282P1G03 v.28 (SEQ ID NO: 195)

```
v.28     1  cggaccctgcgcgcccccgtcccggctcccggccggctcgggggagaagg  50
            ||||||||||||||||||||||||||||||||||||||||||||||||||
v.1      1  cggaccctgcgcgcccccgtcccggctcccggccggctcgggggagaagg  50

v.28    51  cgcccgaggggaggcgccggacagatcgcgtttcggaggcggcgca----  96
            ||||||||||||||||||||||||||||||||||||||||||||||
v.1     51  cgcccgaggggaggcgccggacagatcgcgtttcggaggcggcgcaggtg  100

v.28    97  --------------------------------------------------  96

v.1    101  ctgtaaactgcaaaccataatcctgtcttaatactgcaaacaaatcatag  150

v.28    97  --------------------------gtttccaggttaactaaggtctca  120
                                      ||||||||||||||||||||||||
v.1    151  tggaactaaggggaacttaatttactgtttccaggttaactaaggtctca  200

v.28   121  gctgtaaaccaaaagtgagaggagacattaagattttcattcttaccggg  170
            ||||||||||||||||||||||||||||||||||||||||||||||||||
v.1    201  gctgtaaaccaaaagtgagaggagacattaagattttcattcttaccggg  250

v.28   171  ttgtcttcttcctgaagagcaatggagccgcttttacttggaagaggact  220
            ||||||||||||||||||||||||||||||||||||||||||||||||||
v.1    251  ttgtcttcttcctgaagagcaatggagccgcttttacttggaagaggact  300

v.28   221  aatcgtatatctaatgttcctcctgttaaaattctcaaaagcaattgaaa  270
            ||||||||||||||||||||||||||||||||||||||||||||||||||
v.1    301  aatcgtatatctaatgttcctcctgttaaaattctcaaaagcaattgaaa  350

v.28   271  taccatcttcagttcaacaggttccaacaatcataaaacagtcaaaagtc  320
            ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

```
v.1    351  taccatcttcagttcaacaggttccaacaatcataaaacagtcaaaagtc  400

v.28   321  caagttgcctttcccttcgatgagtattttcaaattgaatgtgaagctaa  370
            ||||||||||||||||||||||||||||||||||||||||||||||||||
v.1    401  caagttgcctttcccttcgatgagtattttcaaattgaatgtgaagctaa  450

v.28   371  aggaaatccagaaccaacattttcgtggactaaggatggcaacccttttt  420
            ||||||||||||||||||||||||||||||||||||||||||||||||||
v.1    451  aggaaatccagaaccaacattttcgtggactaaggatggcaacccttttt  500

v.28   421  atttcactgaccatcggataattccatcgaacaattcaggaacattcagg  470
            ||||||||||||||||||||||||||||||||||||||||||||||||||
v.1    501  atttcactgaccatcggataattccatcgaacaattcaggaacattcagg  550

v.28   471  atcccaaacgaggggcacatatctcactttcaagggaaataccgctgctt  520
            ||||||||||||||||||||||||||||||||||||||||||||||||||
v.1    551  atcccaaacgaggggcacatatctcactttcaagggaaataccgctgctt  600

v.28   521  tgcttcaaataaactgggaatcgctatgtcagaagaaatagaatttatag  570
            ||||||||||||||||||||||||||||||||||||||||||||||||||
v.1    601  tgcttcaaataaactgggaatcgctatgtcagaagaaatagaatttatag  650

v.28   571  ttccaagtgttccaaaactcccaaaagaaaaaattgaccctcttgaagtg  620
            ||||||||||||||||||||||||||||||||||||||||||||||||||
v.1    651  ttccaagtgttccaaaactcccaaaagaaaaaattgaccctcttgaagtg  700

v.28   621  gaggagggagatccaattgtcctcccatgcaatcctcccaaaggcctccc  670
            ||||||||||||||||||||||||||||||||||||||||||||||||||
v.1    701  gaggagggagatccaattgtcctcccatgcaatcctcccaaaggcctccc  750

v.28   671  acctttacacatttattggatgaatattgaattagaacacatcgaacaag  720
            ||||||||||||||||||||||||||||||||||||||||||||||||||
v.1    751  acctttacacatttattggatgaatattgaattagaacacatcgaacaag  800

v.28   721  atgaaagagtatacatgagccaaaagggagatctatacttcgcaaacgtg  770
            ||||||||||||||||||||||||||||||||||||||||||||||||||
v.1    801  atgaaagagtatacatgagccaaaagggagatctatacttcgcaaacgtg  850

v.28   771  gaagaaaaggacagtcgcaatgactactgttgctttgctgcatttccaag  820
            ||||||||||||||||||||||||||||||||||||||||||||||||||
v.1    851  gaagaaaaggacagtcgcaatgactactgttgctttgctgcatttccaag  900

v.28   821  attaaggactattgtacagaaaatgccaatgaaactaacagttaacagtt  870
            ||||||||||||||||||||||||||||||||||||||||||||||||||
v.1    901  attaaggactattgtacagaaaatgccaatgaaactaacagttaacagtt  950

v.28   871  taaagcatgctaatgactcaagttcatccacagaaattggttccaaggca  920
            ||||||||||||||||||||||||||||||||||||||||||||||||||
v.1    951  taaagcatgctaatgactcaagttcatccacagaaattggttccaaggca  1000

v.28   921  aattccatcaagcaaagaaaacccaaactgctgttgcctcccactgagag  970
            ||||||||||||||||||||||||||||||||||||||||||||||||||
v.1   1001  aattccatcaagcaaagaaaacccaaactgctgttgcctcccactgagag  1050

v.28   971  tggcagtgagtcttcaattaccatcctcaaaggggaaatcttgctgcttg  1020
            ||||||||||||||||||||||||||||||||||||||||||||||||||
v.1   1051  tggcagtgagtcttcaattaccatcctcaaaggggaaatcttgctgcttg  1100

v.28  1021  agtgttttgctgaaggcttgccaactccacaggttgattggaacaaaatt  1070
            ||||||||||||||||||||||||||||||||||||||||||||||||||
v.1   1101  agtgttttgctgaaggcttgccaactccacaggttgattggaacaaaatt  1150

v.28  1071  ggtggtgacttaccaaaggggagagaaacaaaagaaaattatggcaagac  1120
            ||||||||||||||||||||||||||||||||||||||||||||||||||
v.1   1151  ggtggtgacttaccaaaggggagagaaacaaaagaaaattatggcaagac  1200

v.28  1121  tttgaagatagagaatgtctcctaccaggacaaaggaaattatcgctgca  1170
            ||||||||||||||||||||||||||||||||||||||||||||||||||
v.1   1201  tttgaagatagagaatgtctcctaccaggacaaaggaaattatcgctgca  1250

v.28  1171  cagccagcaatttcttgggaacagccactcacgattttcacgttatagta  1220
            ||||||||||||||||||||||||||||||||||||||||||||||||||
v.1   1251  cagccagcaatttcttgggaacagccactcacgattttcacgttatagta  1300

v.28  1221  gaagagcctcctcgctggacaaagaagcctcagagtgctgtgtatagcac  1270
            ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

| | | | |
|---|---|---|---|
| v.1 | 1301 | gaagagcctcctcgctggacaaagaagcctcagagtgctgtgtatagcac | 1350 |
| v.28 | 1271 | cggaagcaatggcatcttgttatgtgaggctgaaggagaacctcaaccca | 1320 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1351 | cggaagcaatggcatcttgttatgtgaggctgaaggagaacctcaaccca | 1400 |
| v.28 | 1321 | caatcaagtggagagtcaatggctccccagttgacaatcatccatttgct | 1370 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1401 | caatcaagtggagagtcaatggctccccagttgacaatcatccatttgct | 1450 |
| v.28 | 1371 | ggtgatgttgtcttccccagggaaatcagttttaccaaccttcaaccaaa | 1420 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1451 | ggtgatgttgtcttccccagggaaatcagttttaccaaccttcaaccaaa | 1500 |
| v.28 | 1421 | tcatactgctgtgtaccagtgtgaagcctcaaatgtccatggaactatcc | 1470 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1501 | tcatactgctgtgtaccagtgtgaagcctcaaatgtccatggaactatcc | 1550 |
| v.28 | 1471 | ttgccaatgccaatattgatgttgtggatgtccgtccattgatacaaacc | 1520 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1551 | ttgccaatgccaatattgatgttgtggatgtccgtccattgatacaaacc | 1600 |
| v.28 | 1521 | aaagatggagaaaattacgctacagtggttgggtacagtgctttcttaca | 1570 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1601 | aaagatggagaaaattacgctacagtggttgggtacagtgctttcttaca | 1650 |
| v.28 | 1571 | ttgcgagttctttgcttcacctgaggcagtcgtgtcctggcagaaggtgg | 1620 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1651 | ttgcgagttctttgcttcacctgaggcagtcgtgtcctggcagaaggtgg | 1700 |
| v.28 | 1621 | aagaagtgaaacccctggagggcaggcggtatcatatctatgaaaatggc | 1670 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1701 | aagaagtgaaacccctggagggcaggcggtatcatatctatgaaaatggc | 1750 |
| v.28 | 1671 | acattgcagatcaacagaaccaccgaagaagatgctgggtcttactcatg | 1720 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1751 | acattgcagatcaacagaaccaccgaagaagatgctgggtcttactcatg | 1800 |
| v.28 | 1721 | ttgggtagaaaatgctataggaaaaactgcagtcacagccaatttggata | 1770 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1801 | ttgggtagaaaatgctataggaaaaactgcagtcacagccaatttggata | 1850 |
| v.28 | 1771 | ttagaaatgctacaaaacttagagtttctcctaagaatcctcgtatcccc | 1820 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1851 | ttagaaatgctacaaaacttagagtttctcctaagaatcctcgtatcccc | 1900 |
| v.28 | 1821 | aaattgcatatgcttgaattacattgtgaaagcaaatgtgactcacattt | 1870 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1901 | aaattgcatatgcttgaattacattgtgaaagcaaatgtgactcacattt | 1950 |
| v.28 | 1871 | gaaacacagtttgaagttgtcctggagtaaagatggagaagcctttgaaa | 1920 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 1951 | gaaacacagtttgaagttgtcctggagtaaagatggagaagcctttgaaa | 2000 |
| v.28 | 1921 | ttaatggcacagaagatggcaggataattattgatggagctaatttgacc | 1970 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 2001 | ttaatggcacagaagatggcaggataattattgatggagctaatttgacc | 2050 |
| v.28 | 1971 | atatctaatgtaactttagaggaccaaggtatttactgctgttcagctca | 2020 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 2051 | atatctaatgtaactttagaggaccaaggtatttactgctgttcagctca | 2100 |
| v.28 | 2021 | tactgctctagacagtgctgccgatataactcaagtaactgttcttgatg | 2070 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 2101 | tactgctctagacagtgctgccgatataactcaagtaactgttcttgatg | 2150 |
| v.28 | 2071 | ttccggatccaccagaaaaccttcacttgtctgaaagacagaacaggagt | 2120 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 2151 | ttccggatccaccagaaaaccttcacttgtctgaaagacagaacaggagt | 2200 |
| v.28 | 2121 | gttcggctgacctgggaagctggagctgaccacaacagcaatattagcga | 2170 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |
| v.1 | 2201 | gttcggctgacctgggaagctggagctgaccacaacagcaatattagcga | 2250 |
| v.28 | 2171 | gtatattgttgaatttgaaggaaacaaagaagagcctggaaggtgggagg | 2220 |
| | | \|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\|\| | |

TABLE LIIIh-continued

Nucleatide sequence alignment of 282P1G03 v.1 (SEQ ID NO: 194) and 282P1G03 v.28 (SEQ ID NO: 195)

```
v.1   2251 gtatattgttgaatttgaaggaaacaaagaagagcctggaaggtgggagg 2300

v.28  2221 aactgaccagagtccaaggaaagaaaaccacagttatcttacctttggct 2270
           ||||||||||||||||||||||||||||||||||||||||||||||||||
v.1   2301 aactgaccagagtccaaggaaagaaaaccacagttatcttacctttggct 2350

v.28  2271 ccatttgtgagataccagttcagggtcatagccgtgaacgaagtagggag 2320
           ||||||||||||||||||||||||||||||||||||||||||||||||||
v.1   2351 ccatttgtgagataccagttcagggtcatagccgtgaacgaagtagggag 2400

v.28  2321 aagtcagcctagccagccgtcagaccatcatgaaacaccaccagcagctc 2370
           ||||||||||||||||||||||||||||||||||||||||||||||||||
v.1   2401 aagtcagcctagccagccgtcagaccatcatgaaacaccaccagcagctc 2450

v.28  2371 cagataggaatccacaaaacataagggttcaagcctctcaacccaaggaa 2420
           ||||||||||||||||||||||||||||||||||||||||||||||||||
v.1   2451 cagataggaatccacaaaacataagggttcaagcctctcaacccaaggaa 2500

v.28  2421 atgattataaagtgggagcctttgaaatccatggagcagaatggaccagg 2470
           ||||||||||||||||||||||||||||||||||||||||||||||||||
v.1   2501 atgattataaagtgggagcctttgaaatccatggagcagaatggaccagg 2550

v.28  2471 cctagagtacagagtgacctggaagccacagggagccccagtggagtggg 2520
           ||||||||||||||||||||||||||||||||||||||||||||||||||
v.1   2551 cctagagtacagagtgacctggaagccacagggagccccagtggagtggg 2600

v.28  2521 aagaagaaacagtcacaaaccacacattgcgggtgatgacgcctgctgtc 2570
           ||||||||||||||||||||||||||||||||||||||||||||||||||
v.1   2601 aagaagaaacagtcacaaaccacacattgcgggtgatgacgcctgctgtc 2650

v.28  2571 tatgccccttatgatgtcaaggtccaggctatcaatcaactaggatctgg 2620
           ||||||||||||||||||||||||||||||||||||||||||||||||||
v.1   2651 tatgccccttatgatgtcaaggtccaggctatcaatcaactaggatctgg 2700

v.28  2621 gcctgaccctcagtcagtgactctctattctggagaagactatcctgata 2670
           ||||||||||||||||||||||||||||||||||||||||||||||||||
v.1   2701 gcctgaccctcagtcagtgactctctattctggagaagactatcctgata 2750

v.28  2671 cagctccagtgatccatggggtggacgttataaacagtacattagttaaa 2720
           ||||||||||||||||||||||||||||||||||||||||||||||||||
v.1   2751 cagctccagtgatccatggggtggacgttataaacagtacattagttaaa 2800

v.28  2721 gttacctggtcaacagttccaaaggacagagtacatggacgtctgaaagg 2770
           ||||||||||||||||||||||||||||||||||||||||||||||||||
v.1   2801 gttacctggtcaacagttccaaaggacagagtacatggacgtctgaaagg 2850

v.28  2771 ctatcagataaattggtggaaaacaaaaagtctgttggatggaagaacac 2820
           ||||||||||||||||||||||||||||||||||||||||||||||||||
v.1   2851 ctatcagataaattggtggaaaacaaaaagtctgttggatggaagaacac 2900

v.28  2821 atcccaaagaagtgaacattctaagattttcaggacaaagaaactctgga 2870
           ||||||||||||||||||||||||||||||||||||||||||||||||||
v.1   2901 atcccaaagaagtgaacattctaagattttcaggacaaagaaactctgga 2950

v.28  2871 atggttccttccttagatgcctttagtgaatttcatttaacagtcttagc 2920
           ||||||||||||||||||||||||||||||||||||||||||||||||||
v.1   2951 atggttccttccttagatgcctttagtgaatttcatttaacagtcttagc 3000

v.28  2921 ctataactctaaaggagctggtcctgaaagtgagccttatatatttcaaa 2970
           ||||||||||||||||||||||||||||||||||||||||||||||||||
v.1   3001 ctataactctaaaggagctggtcctgaaagtgagccttatatatttcaaa 3050

v.28  2971 caccagaaggagtacctgaacagccaacttttctaaaggtcatcaaagtt 3020
           ||||||||||||||||||||||||||||||||||||||||||||||||||
v.1   3051 caccagaaggagtacctgaacagccaacttttctaaaggtcatcaaagtt 3100

v.28  3021 gataaagacactgccactttatcttggggactacctaagaaattaaatgg 3070
           ||||||||||||||||||||||||||||||||||||||||||||||||||
v.1   3101 gataaagacactgccactttatcttggggactacctaagaaattaaatgg 3150

v.28  3071 aaacttaactggctatcttttgcaatatcagataataaatgacacctacg 3120
           ||||||||||||||||||||||||||||||||||||||||||||||||||
v.1   3151 aaacttaactggctatcttttgcaatatcagataataaatgacacctacg 3200

v.28  3121 agattggagaattaaatgatattaacattacaactccatcaaagcccagc 3170
           ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

| | | | |
|---|---|---|---|
| v.1 | 3201 | agattggagaattaaatgatattaacattacaactccatcaaagcccagc | 3250 |
| v.28 | 3171 | tggcacctctcaaacctgaatgcaactaccaagtacaaattctacttgag | 3220 |
| v.1 | 3251 | tggcacctctcaaacctgaatgcaactaccaagtacaaattctacttgag | 3300 |
| v.28 | 3221 | ggcttgcacttcacagggctgtggaaaaccgatcacggaggaaagctcca | 3270 |
| v.1 | 3301 | ggcttgcacttcacagggctgtggaaaaccgatcacggaggaaagctcca | 3350 |
| v.28 | 3271 | ccttaggagaagggagtaaaggtatcgggaagatatcaggagtaaatctt | 3320 |
| v.1 | 3351 | ccttaggagaagggagtaaaggtatcgggaagatatcaggagtaaatctt | 3400 |
| v.28 | 3321 | actcaaaagactcacccaatagaggtatttgagccgggagctgaacatat | 3370 |
| v.1 | 3401 | actcaaaagactcacccaatagaggtatttgagccgggagctgaacatat | 3450 |
| v.28 | 3371 | agttcgcctaatgactaagaattggggcgataacgatagcatttttcaag | 3420 |
| v.1 | 3451 | agttcgcctaatgactaagaattggggcgataacgatagcatttttcaag | 3500 |
| v.28 | 3421 | atgtaattgagacaagagggagagaatatgctggtttatatgatgacatc | 3470 |
| v.1 | 3501 | atgtaattgagacaagagggagagaatatgctggtttatatgatgacatc | 3550 |
| v.28 | 3471 | tccactcaaggctggtttattggactgatgtgtgcgattgctcttctcac | 3520 |
| v.1 | 3551 | tccactcaaggctggtttattggactgatgtgtgcgattgctcttctcac | 3600 |
| v.28 | 3521 | actactattattaactgtttgctttgtgaagaggaatagaggtggaaagt | 3570 |
| v.1 | 3601 | actactattattaactgtttgctttgtgaagaggaatagaggtggaaagt | 3650 |
| v.28 | 3571 | actcagttaaagaaaaggaagatttgcatccagacccagaaattcagtca | 3620 |
| v.1 | 3651 | actcagttaaagaaaaggaagatttgcatccagacccagaaattcagtca | 3700 |
| v.28 | 3621 | gtaaaagatgaaacctttggtgaatacagtgacagtgatgaaaagcctct | 3670 |
| v.1 | 3701 | gtaaaagatgaaacctttggtgaatacagtgacagtgatgaaaagcctct | 3750 |
| v.28 | 3671 | caaaggaagccttcggtcccttaatagggatatgcagcctactgaaagtg | 3720 |
| v.1 | 3751 | caaaggaagccttcggtcccttaatagggatatgcagcctactgaaagtg | 3800 |
| v.28 | 3721 | ctgacagcttagtcgaatacggagagggagaccatggtctcttcagtgaa | 3770 |
| v.1 | 3801 | ctgacagcttagtcgaatacggagagggagaccatggtctcttcagtgaa | 3850 |
| v.28 | 3771 | gatggatcatttattggtgcctacgctggatctaaggagaagggatctgt | 3820 |
| v.1 | 3851 | gatggatcatttattggtgcctacgctggatctaaggagaagggatctgt | 3900 |
| v.28 | 3821 | tgaaagcaatggaagttctacagcaacttttccccttcgggcataaacac | 3870 |
| v.1 | 3901 | tgaaagcaatggaagttctacagcaacttttccccttcgggcataaacac | 3950 |
| v.28 | 3871 | aacatatgtaagcaacgctactggttcaccccaaccttccatatttatct | 3920 |
| v.1 | 3951 | aacatatgtaagcaacgctactggttcaccccaaccttccatatttatct | 4000 |
| v.28 | 3921 | gttcaaaggagcaagaactttcatataggaatagaaacatgctggccgaa | 3970 |
| v.1 | 4001 | gttcaaaggagcaagaactttcatataggaatagaaacatgctggccgaa | 4050 |
| v.28 | 3971 | gatttcatccagaagtcaacatcctgcaattatgttgaaaagagtagtac | 4020 |
| v.1 | 4051 | gatttcatccagaagtcaacatcctgcaattatgttgaaaagagtagtac | 4100 |
| v.28 | 4021 | tttcttcaaaatataaaatgccaagcacttcaggcctatgttttgcttat | 4070 |
| v.1 | 4101 | tttcttcaaaatataaaatgcoaagcacttcaggcctatgttttgcttat | 4150 |
| v.28 | 4071 | attgttttcaggtgctcaaaatgcaaaacacaaaacaaatcctgcattta | 4120 |

TABLE LIIIh-continued

Nucleatide sequence alignment of 282P1G03 v.1 (SEQ ID NO: 194) and 282P1G03 v.28 (SEQ ID NO: 195)

```
v.1    4151  attgttttcaggtgctcaaaatgcaaaacacaaaacaaatcctgcattta  4200

v.28   4121  gatacacctcaactaaatccaaagtccccattcagtatattccatatttg  4170
             ||||||||||||||||||||||||||||||||||||||||||||||||||
v.1    4201  gatacacctcaactaaatccaaagtccccattcagtatattccatatttg  4250

v.28   4171  cctgattttactattcggtgtgtttgcatagatgttgctacttggtgggt  4220
             ||||||||||||||||||||||||||||||||||||||||||||||||||
v.1    4251  cctgattttactattcggtgtgtttgcatagatgttgctacttggtgggt  4300

v.28   4221  ttttctccgtatgcacattggtatacagtctctgagaactggcttggtga  4270
             ||||||||||||||||||||||||||||||||||||||||||||||||||
v.1    4301  ttttctccgtatgcacattggtatacagtctctgagaactggcttggtga  4350

v.28   4271  ctttgcttcactacaggttaaaagaccataagcaaactggttatttaaaa  4320
             ||||||||||||||||||||||||||||||||||||||||||||||||||
v.1    4351  ctttgcttcactacaggttaaaagaccataagcaaactggttatttaaaa  4400

v.28   4321  tgtaaaaaggaatatgaaagtcttattaaaacacttcattgaaaatatac  4370
             ||||||||||||||||||||||||||||||||||||||||||||||||||
v.1    4401  tgtaaaaaggaatatgaaagtcttattaaaacacttcattgaaaatatac  4450

v.28   4371  agtctaaatttattatttaaattttactagcaaaagtcttaggtgaacaa  4420
             ||||||||||||||||||||||||||||||||||||||||||||||||||
v.1    4451  agtctaaatttattatttaaattttactagcaaaagtcttaggtgaacaa  4500

v.28   4421  tcaactagtatttgttgagctcctatttgcccagagatggtcatatttaa  4470
             ||||||||||||||||||||||||||||||||||||||||||||||||||
v.1    4501  tcaactagtatttgttgagctcctatttgcccagagatggtcatatttaa  4550

v.28   4471  acagaagtatacgtttttcagtttcaacatgaatttttttatttctgtca  4520
             ||||||||||||||||||||||||||||||||||||||||||||||||||
v.1    4551  acagaagtatacgtttttcagtttcaacatgaatttttttatttctgtca  4600

v.28   4521  gttatgacatccacgagcatcacttttttgtgtctgttttttttttttttct  4570
             ||||||||||||||||||||||||||||||||||||||||||||||||||
v.1    4601  gttatgacatccacgagcatcacttttttgtgtctgttttttttttttttct  4650

v.28   4571  tggactaaattcaactgcatggaagcggtggtcagaaggttgttttatac  4620
             ||||||||||||||||||||||||||||||||||||||||||||||||||
v.1    4651  tggactaaattcaactgcatggaagcggtggtcagaaggttgttttatac  4700

v.28   4621  gagaacaggcagaaagtgcccattgttcaggattctaatagctacatcta  4670
             ||||||||||||||||||||||||||||||||||||||||||||||||||
v.1    4701  gagaacaggcagaaagtgcccattgttcaggattctaatagctacatcta  4750

v.28   4671  cttaatatcttcatttctaaattgactgcttttaccttttttctcatgttt  4720
             ||||||||||||||||||||||||||||||||||||||||||||||||||
v.1    4751  cttaatatcttcatttctaaattgactgcttttaccttttttctcatgttt  4800

v.28   4721  atataatggtatgcttgcatatatttcatgaatacattgtacatattatg  4770
             ||||||||||||||||||||||||||||||||||||||||||||||||||
v.1    4801  atataatggtatgcttgcatatatttcatgaatacattgtacatattatg  4850

v.28   4771  ttaatatttacacaatttaaaatatagatgtgttttattttgaagtgaga  4820
             ||||||||||||||||||||||||||||||||||||||||||||||||||
v.1    4851  ttaatatttacacaatttaaaatatagatgtgttttattttgaagtgaga  4900

v.28   4821  aaatgaacattaacaggcatgtttgtacagctagaatatattagtaagat  4870
             ||||||||||||||||||||||||||||||||||||||||||||||||||
v.1    4901  aaatgaacattaacaggcatgtttgtacagctagaatatattagtaagat  4950

v.28   4871  actgtttttcgtcattccagagctacaactaataacacgaggttccaaag  4920
             ||||||||||||||||||||||||||||||||||||||||||||||||||
v.1    4951  actgtttttcgtcattccagagctacaactaataacacgaggttccaaag  5000

v.28   4921  ctgaagactttgtataaagtatttgggttttgttcttgtattgctttctt  4970
             ||||||||||||||||||||||||||||||||||||||||||||||||||
v.1    5001  ctgaagactttgtataaagtatttgggttttgttcttgtattgctttctt  5050

v.28   4971  tcaacagtttcaaaataaaatatcatacaaatattgagggaaatgttttc  5020
             ||||||||||||||||||||||||||||||||||||||||||||||||||
v.1    5051  tcaacagtttcaaaataaaatatcatacaaatattgagggaaatgttttc  5100

v.28   5021  atatttttcaaaataggtttttattgttgaatgtacatctaccccagccc  5070
             ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

```
v.1    5101  atatttttcaaaataggttttttattgttgaatgtacatctaccccagccc  5150

v.28   5071  ctcaaaagaaaaactgtttacatagaaattcctacacatacgtttgcgta  5120
             ||||||||||||||||||||||||||||||||||||||||||||||||||
v.1    5151  ctcaaaagaaaaactgtttacatagaaattcctacacatacgtttgcgta  5200

v.28   5121  tatgttattttaaacatctttgtggtgagaatttttttccccgatattctc  5170
             ||||||||||||||||||||||||||||||||||||||||||||||||||
v.1    5201  tatgttattttaaacatctttgtggtgagaatttttttccccgatattctc  5250

v.28   5171  cttctgtcaaagtcagaacaaattcagggaatttattttctggcagttgt  5220
             ||||||||||||||||||||||||||||||||||||||||||||||||||
v.1    5251  cttctgtcaaagtcagaacaaattcagggaatttattttctggcagttgt  5300

v.28   5221  gctccagtccttttaaaattgtacatgaacatgttttagaaacaatatgg  5270
             ||||||||||||||||||||||||||||||||||||||||||||||||||
v.1    5301  gctccagtccttttaaaattgtacatgaacatgttttagaaacaatatgg  5350

v.28   5271  aggatgatgcatacatgtcggtcaagttcagcgctcgacattttatggaa  5320
             ||||||||||||||||||||||||||||||||||||||||||||||||||
v.1    5351  aggatgatgcatacatgtcggtcaagttcagcgctcgacattttatggaa  5400

v.28   5321  agatttttttaaccttaccacgaaatacttaactactgtttaagtgaatt  5370
             ||||||||||||||||||||||||||||||||||||||||||||||||||
v.1    5401  agatttttttaaccttaccacgaaatacttaactactgtttaagtgaatt  5450

v.28   5371  gacttatttcactttagtttttgaactgtgattattggtatactgttata  5420
             ||||||||||||||||||||||||||||||||||||||||||||||||||
v.1    5451  gacttatttcactttagtttttgaactgtgattattggtatactgttata  5500

v.28   5421  tcctcaacttggatttatggtaacccctttttagttcatggagaccaaaat  5470
             ||||||||||||||||||||||||||||||||||||||||||||||||||
v.1    5501  tcctcaacttggatttatggtaacccctttttagttcatggagaccaaaat  5550

v.28   5471  ttggggtatttataatagtcagcgcaggaatgcacatggaatatctactt  5520
             ||||||||||||||||||||||||||||||||||||||||||||||||||
v.1    5551  ttggggtatttataatagtcagcgcaggaatgcacatggaatatctactt  5600

v.28   5521  gtccttttgaacctcacgagtcatccagaatgtatagacaggaaaagcat  5570
             ||||||||||||||||||||||||||||||||||||||||||||||||||
v.1    5601  gtccttttgaacctcacgagtcatccagaatgtatagacaggaaaagcat  5650

v.28   5571  gtcttatttaaaactgtaatttatgggctcaggatctgaccgcagtcccg  5620
             ||||||||||||||||||||||||||||||||||||||||||||||||||
v.1    5651  gtcttatttaaaactgtaatttatgggctcaggatctgaccgcagtcccg  5700

v.28   5621  ggagtaagcatttcaaagggggaaggcagtgtggtccctaccctgtgtga  5670
             ||||||||||||||||||||||||||||||||||||||||||||||||||
v.1    5701  ggagtaagcatttcaaagggggaaggcagtgtggtccctaccctgtgtga  5750

v.28   5671  atgtgaggatgtagacatccatcagtgcaactcgagctccatcctcctcc  5720
             ||||||||||||||||||||||||||||||||||||||||||||||||||
v.1    5751  atgtgaggatgtagacatccatcagtgcaactcgagctccatcctcctcc  5800

v.28   5721  gatttctaaggctccagttttctggagggacagtcatcatgttttgattt  5770
             ||||||||||||||||||||||||||||||||||||||||||||||||||
v.1    5801  gatttctaaggctccagttttctggagggacagtcatcatgttttgattt  5850

v.28   5771  atctgggagaaaactgtggtgcacagcttgtgaggagggcaaggttgtga  5820
             ||||||||||||||||||||||||||||||||||||||||||||||||||
v.1    5851  atctgggagaaaactgtggtgcacagcttgtgaggagggcaaggttgtga  5900

v.28   5821  cgttcgagcttagttctggtgttattctgtctcctcttctttgtcatcag  5870
             ||||||||||||||||||||||||||||||||||||||||||||||||||
v.1    5901  cgttcgagcttagttctggtgttattctgtctcctcttctttgtcatcag  5950

v.28   5871  ccaaaacgtggtttttaaagagagtcatgcaggttagaaataatgtcaaa  5920
             ||||||||||||||||||||||||||||||||||||||||||||||||||
v.1    5951  ccaaaacgtggtttttaaagagagtcatgcaggttagaaataatgtcaaa  6000

v.28   5921  aatatttaggaatttaataacctttaagtcagaaactaaaacaaatactg  5970
             ||||||||||||||||||||||||||||||||||||||||||||||||||
v.1    6001  aatatttaggaatttaataacctttaagtcagaaactaaaacaaatactg  6050

v.28   5971  aaatattagctcttcctacacttcgtgttcccctttagctgcctgaaaat  6020
             ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

```
v.1    6051  aaatattagctcttcctacacttcgtgttcccctttagctgcctgaaaat  6100

v.28   6021  caagattgctcctactcagatcttctgagtggctaaaacttatggatatg  6070
             ||||||||||||||||||||||||||||||||||||||||||||||||||
v.1    6101  caagattgctcctactcagatcttctgagtggctaaaacttatggatatg  6150

v.28   6071  aaaaatgagattgaatgatgactatgctttgctatcattgttacctttcc  6120
             ||||||||||||||||||||||||||||||||||||||||||||||||||
v.1    6151  aaaaatgagattgaatgatgactatgctttgctatcattgttacctttcc  6200

v.28   6121  tcaatactatttggcaactactgggactcttcagcacaaaaggaatagat  6170
             ||||||||||||||||||||||||||||||||||||||||||||||||||
v.1    6201  tcaatactatttggcaactactgggactcttcagcacaaaaggaatagat  6250

v.28   6171  ctatgattgaccctgattttaattgtgaaattatatgattcatatatttt  6220
             ||||||||||||||||||||||||||||||||||||||||||||||||||
v.1    6251  ctatgattgaccctgattttaattgtgaaattatatgattcatatatttt  6300

v.28   6221  atgaatcagaataaccttcaaataaaataaatctaagtcggttaaaatgg  6270
             ||||||||||||||||||||||||||||||||||||||||||||||||||
v.1    6301  atgaatcagaataaccttcaaataaaataaatctaagtcggttaaaatgg  6350

v.28   6271  atttcatgattttccctcagaaaatgagtaacggagtccacggcgtgcaa  6320
             ||||||||||||||||||||||||||||||||||||||||||||||||||
v.1    6351  atttcatgattttccctcagaaaatgagtaacggagtccacggcgtgcaa  6400

v.28   6321  tggtaattataaattggtgatgcttgtttgcaaattgcccactcgtgata  6370
             ||||||||||||||||||||||||||||||||||||||||||||||||||
v.1    6401  tggtaattatiaaattggtgatgcttgtttgcaaattgcccactcgtgata 6450

v.28   6371  agtcaacagccaatatttaaaactttgttcgttactggctttaccctaac  6420
             ||||||||||||||||||||||||||||||||||||||||||||||||||
v.1    6451  agtcaacagccaatatttaaaactttgttcgttactggctttaccctaac  6500

v.28   6421  tttctctagtctactgtcaatatcattttaatgtaattgattgtatatag  6470
             ||||||||||||||||||||||||||||||||||||||||||||||||||
v.1    6501  tttctctagtctactgtcaatatcattttaatgtaattgattgtatatag  6550

v.28   6471  tctcaagaatggttggtgggcatgagttcccagagaactgtccaagggtt  6520
             ||||||||||||||||||||||||||||||||||||||||||||||||||
v.1    6551  tctcaagaatggttggtgggcatgagttcctagagaactgtccaagggtt  6600

v.28   6521  gggaaaatccaaattctcttcctggctccagcactgattttgtacataaa  6570
             ||||||||||||||||||||||||||||||||||||||||||||||||||
v.1    6601  gggaaaatccaaattctcttcctggctccagcactgattttgtacataaa  6650

v.28   6571  cattaggcaggttgcttaaccttttttatttcaaactctctcaactctaaa  6620
             ||||||||||||||||||||||||||||||||||||||||||||||||||
v.1    6651  cattaggcaggttgcttaaccttttttatttcaaactctctcaactctaaa  6700

v.28   6621  gtgctaataataatctcagttaccttatctttgtcacagggtgttctttt  6670
             ||||||||||||||||||||||||||||||||||||||||||||||||||
v.1    6701  gtgctaataataatctcagttaccttatctttgtcacagggtgttctttt  6750

v.28   6671  ttatgaagaaaaatttgaaaatgataaaagctaagatgccttctaacttc  6720
             ||||||||||||||||||||||||||||||||||||||||||||||||||
v.1    6751  ttatgaagaaaaatttgaaaatgataaaagctaagatgccttctaacttc  6800

v.28   6721  ataagcaaacctttaactaattatgtatctgaaagtcacccccacatacc  6770
             ||||||||||||||||||||||||||||||||||||||||||||||||||
v.1    6801  ataagcaaacctttaactaattatgtatctgaaagtcacccccacatacc  6850

v.28   6771  aactcaactttttttcctgtgaacacataaatatatttttatagaaaaaca  6820
             ||||||||||||||||||||||||||||||||||||||||||||||||||
v.1    6851  aactcaactttttttcctgtgaacacataaatatatttttatagaaaaaca  6900

v.28   6821  aatctacataaaataaatctactgtttagtgagcagtatgacttgtacat  6870
             ||||||||||||||||||||||||||||||||||||||||||||||||||
v.1    6901  aatctacataaaataaatctactgtttagtgagcagtatgacttgtacat  6950

v.28   6871  gccattgaaaattattaatcagaagaaaattaagcagggtctttgctata  6920
             ||||||||||||||||||||||||||||||||||||||||||||||||||
v.1    6951  gccattgaaaattattaatcagaagaaaattaagcagggtctttgctata  7000

v.28   6921  caaaagtgttttccactaattttgcatgcgtatttataagaaaaatgtga  6970
             ||||||||||||||||||||||||||||||||||||||||||||||||||
```

TABLE LIIIh-continued

Nucleatide sequence alignment of 282P1G03 v.1 (SEQ ID NO: 194) and 282P1G03 v.28 (SEQ ID NO: 195)

```
v.1   7001 caaaagtgttttccactaattttgcatgcgtatttataagaaaaatgtga 7050

v.28  6971 atttggtggttttattctatcggtataaaggcatcgatattttagatgca 7020
           ||||||||||||||||||||||||||||||||||||||||||||||||||
v.1   7051 atttggtggttttattctatcggtataaaggcatcgatattttagatgca 7100

v.28  7021 cccgtgtttgtaaaaatgtagagcacaatggaattatgctggaagtctca 7070
           ||||||||||||||||||||||||||||||||||||||||||||||||||
v.1   7101 cccgtgtttgtaaaaatgtagagcacaatggaattatgctggaagtctca 7150

v.28  7071 aataatatttttttcctattttatactcatggaagagataagctaaagag 7120
           ||||||||||||||||||||||||||||||||||||||||||||||||||
v.1   7151 aataatatttttttcctattttatactcatggaagagataagctaaagag 7200

v.28  7121 gggacaataatgagaaatgttggtgtgcttttctaagcatttaaaacata 7170
           ||||||||||||||||||||||||||||||||||||||||||||||||||
v.1   7201 gggacaataatgagaaatgttggtgtgcttttccaagcatttaaaacata 7250

v.28  7171 attgccaattgaaaccctaaatatgtttacataccattaagatatgattc 7220
           ||||||||||||||||||||||||||||||||||||||||||||||||||
v.1   7251 attgccaattgaaaccctaaatatgtttacataccattaagatatgattc 7300

v.28  7221 atgtaacaatgttaaattaattataatgggattgggtttgttatctgtgg 7270
           ||||||||||||||||||||||||||||||||||||||||||||||||||
v.1   7301 atgtaacaatgttaaattaattataatgggattgggtttgttatctgtgg 7350

v.28  7271 tagtatatatcctagtgttcctatagtgaaataagtagggttcagccaaa 7320
           ||||||||||||||||||||||||||||||||||||||||||||||||||
v.1   7351 tagtatatatcctagtgttcctatagtgaaataagtagggttcagccaaa 7400

v.28  7321 gctttctttgttttgtaccttaaattgttcgattacgtcatcaaaagaga 7370
           ||||||||||||||||||||||||||||||||||||||||||||||||||
v.1   7401 gctttctttgttttgtaccttaaattgttcgattacgtcatcaaaagaga 7450

v.28  7371 tgaaaggtatgtagaacaggttcacgtgattaccttttttcttttggcttg 7420
           ||||||||||||||||||||||||||||||||||||||||||||||||||
v.1   7451 tgaaaggtatgtagaacaggttcacgtgattaccttttttcttttggcttg 7500

v.28  7421 gattaatattcatagtagaactttataaaacgtgtttgtattgtaggtgg 7470
           ||||||||||||||||||||||||||||||||||||||||||||||||||
v.1   7501 gattaatattcatagtagaactttataaaacgtgtttgtattgtaggtgg 7550

v.28  7471 tgtttgtattatgcttatgactatgtatggtttgaaaatattttcattat 7520
           ||||||||||||||||||||||||||||||||||||||||||||||||||
v.1   7551 tgtttgtattatgcttatgactatgtatggtttgaaaatattttcattat 7600

v.28  7521 acatgaaattcaactttccaaataaaagttctacttcatgtaatccaaaa 7570
           ||||||||||||||||||||||||||||||||||||||||||||||||||
v.1   7601 acatgaaattcaactttccaaataaaagttctacttcatgtaatccaaaa 7650
```

TABLE LIVh

Peptide sequences of protein coded by 282P1G03 v.28

```
                                                  (SEQ ID NO:196)
MEPLLLGRGL IVYLMFLLLK FSKAIEIPSS VQQVPTIIKQ SKVQVAFPFD EYFQIECEAK  60

GNPEPTFSWT KDGNPFYFTD HRIIPSNNSG TFRIPNEGHI SHFQGKYRCF ASNKLGIANS 120

EEIEFIVPSV PKLPKEKIDP LEVEEGDPIV LPCNPPKGLP PLHIYWMNIE LEHIEQDERV 180

YMSQKGDLYF ANVEEKDSRN DYCCFAAFPR LRTIVQKMPM KLTVNSLKHA NDSSSSTEIG 240

SKANSIKQRK PKLPKEKIDP GSESSITILK GEILLLECFA EGLPTPQVDW NKIGGDLPKG 300

RETKENYGKT LKIENVSYQD KGNYRCTASN FLGTATHDFH VIVEEPPRWT KKPQSAVYST 360

GSNGILLCEA EGEPQPTIKW RVNGSPVDNH PFAGDVVFPR EISFTNLQPN HTAVYQCEAS 420

NVHGTILANA NIDVVDVRPL IQTKDGENYA TVVGYSAFLH CEFFASPEAV VSWQKVEEVK 480

PLEGRRYHIY ENGTLQINRT TEEDAGSYSC WVENAIGKTA VTANLDIRNA TKLRVSPKNP 540
```

TABLE LIVh-continued

Peptide sequences of protein coded by 282P1G03 v.28

```
RIPKLHMLEL HCESKCDSHL KHSLKLSWSK DGEAFEINGT EDGRIIIDGA NLTISNVTLE   600

DQGIYCCSAH TALDSAADIT QVTVLDVPDP PEHLHLSERQ NRSVRLTWEA GADHNSNISE   660

YIVEFEGNKE EPGRWEELTR VQGKKTTVIL PLAPFVRYQF RVIAVNEVGR SQPSQPSDHH   720

ETPPAAPDRN PQNIRVQASQ PKEMTIKWEP LKSMEQNGPG LEYRVTWKPQ GAPVEWEEET   780

VTNHTLRVMT PAVYAPYDVK VQAINQLGSG PDPQSVTLYS GEDYPDTAPV IHGVDVINST   840

LVKVTWSTVP KDRVHGRLKG YQINWWKTKS LLDGRTHPKE VNILRFSGQR NSGMVPSLDA   900

FSEPHLTVLA YNSKGAGPES EPYIFQTPEG VPEQPTFLKV IKVDKDTATL SWGLPKKLNG   960

NLTGYLLQYQ IINDTYEIGE LNDINITTPS KPSWHLSNLN ATTKYKFYLR ACTSQGCGKP  1020

ITEESSTLGE OSKGIGKISG VNLTQKTHPI EVFEPGAEHI VRLMTKNWGD NDSIFQDVIE  1080

TRGREYAGLY DDISTQGWFI GLMCAIALLT LLLLTVCFVK RNRGGKYSVK EKEDLHPDPE  1140

IQSVKDETFG EYSDSDEKPL KGSLRSLNRD MQPTESADSL VEYGEGDHGL FSEDGSFIGA  1200

YAGSKEKGSV ESNGSSTATF PLRA  1224
```

TABLE LVh

Amino acid sequence alignment of 282P1G03 v.1 (SEQ ID NO: 197) and 282P1G03 v.28 (SEQ ID NO: 198)

```
v.28    1  MEPLLLGRGLIVYLMFLLLKFSKAIEIPSSVQQVPTIIKQSKVQVAFPFD   50
           ||||||||||||||||||||||||||||||||||||||||||||||||||
v.1     1  MEPLLLGRGLIVYLMFLLLKFSKAIEIPSSVQQVPTIIKQSKVQVAFPFD   50

v.28   51  EYFQIECEAKGNPEPTFSWTKDGNPFYFTDHRIIPSNNSGTFRIPNEGHI  100
           ||||||||||||||||||||||||||||||||||||||||||||||||||
v.1    51  EYFQIECEAKGNPEPTFSWTKDGNPFYFTDHRIIPSNNSGTFRIPNEGHI  100

v.28  101  SHFQGKYRCFASNKLGIAMSEEIEFIVPSVPKLPKEKIDPLEVEEGDPIV  150
           ||||||||||||||||||||||||||||||||||||||||||||||||||
v.1   101  SHFQGKYRCFASNKLGIAMSEEIEFIVPSVPKLPKEKIDPLEVEEGDPIV  150

v.28  151  LPCNPPKGLPPLHIYWMNIELEHIEQDERVYMSQKGDLYFANVEEKDSRN  200
           ||||||||||||||||||||||||||||||||||||||||||||||||||
v.1   151  LPCNPPKGLPPLHIYWMNIELEHIEQDERVYMSQKGDLYFANVEEKDSRN  200

v.28  201  DYCCFAAFPRLRTIVQKMPMKLTVNSLKHANDSSSSTEIGSKANSIKQRK  250
           ||||||||||||||||||||||||||||||||||||||||||||||||||
v.1   201  DYCCFAAFPRLRTIVQKMPMKLTVNSLKHANDSSSSTEIGSKANSIKQRK  250

v.28  251  PKLLLPPTESGSESSITILKGEILLLECFAEGLPTPQVDWNKIGGDLPKG  300
           ||||||||||||||||||||||||||||||||||||||||||||||||||
v.1   251  PKLLLPPTESGSESSITILKGEILLLECFAEGLPTPQVDWNKIGGDLPKG  300

v.28  301  RETKENYGKTLKIENVSYQDKGNYRCTASNFLGTATHDFHVIVEEPPRWT  350
           ||||| |||||||||||||||||||||||||||||||||||||||||||
v.1   301  RETKEMYGKTLKIENVSYQDKGNYRCTASNFLGTATHDFHVIVEEPPRWT  350

v.28  351  KKPQSAVYSTGSNGILLCEAEGEPQPTIKWRVNGSPVDNHPFAGDVVFPR  400
           ||||||||||||||||||||||||||||||||||||||||||||||||||
v.1   351  KKPQSAVYSTGSNGILLCEAEGEPQPTIKWRVNGSPVDNHPFAGDVVFPR  400

v.28  401  EISFTNLQPNHTAVYQCEASNVHGTILANANIDVVDVRPLIQTKDGENYA  450
           ||||||||||||||||||||||||||||||||||||||||||||||||||
v.1   401  EISFTNLQPNHTAVYQCEASNVHGTILANANIDVVDVRPLIQTKDGENYA  450

v.28  451  TVVGYSAFLHCEFFASPEAVVSWQKVEEVKPLEGRRYHIYENGTLQINRT  500
           |||||||||||||||||||||||||||||||||||||| |||||||||||
v.1   451  TVVGYSAFLHCEFFASPEAVVSWQKVEEVKPLEGRRYHTYENGTLQINRT  500

v.28  501  TEEDAGSYSCWVENAIGKTAVTANLDIRNATKLRVSPKNPRIPKLHMLEL  550
           ||||||||||||||||||||||||||||||||||||||||||||||||||
v.1   501  TEEDAGSYSCWVENAIGKTAVTANLDIRNATKLRVSPKNPRIPKLHMLEL  550

v.28  551  HCESKCDSHLKHSLKLSWSKDGEAFEINGTEDGRIIIDGANLTISNVTLE  600
```

TABLE LVh-continued

Amino acid sequence alignment of 282P1G03 v.1 (SEQ ID NO: 197) and 282P1G03 v.28 (SEQ ID NO: 198)

```
               ||||||||||||||||||||||||||||||||||||||||||||||||||
v.1      551   HCESKCDSHLKHSLKLSWSKDGEAFEINGTEDGRIIIDGANLTISNVTLE  600

v.28     601   DQGIYCCSAHTALDSAADITQVTVLDVPDPPENLHLSERQNRSVRLTWEA  650
               ||||||||||||||||||||||||||||||||||||||||||||||||||
v.1      601   DQGIYCCSAHTALDSAADITQVTVLDVPDPPENLHLSERQNPSVRLTWEA  650

v.28     651   GADHNSNISEYIVEFEGNKEEPGRWEELTRVQGKKTTVILPLAPFVRYQF  700
               ||||||||||||||||||||||||||||||||||||||||||||||||||
v.1      651   GADHNSNISEYIVEFEGNKEEPGRWEELTRVQGKKTTVILPLAPFVRYQF  700

v.28     701   RVIAVNEVGRSQPSQPSDHHETPPAAPDRNPQNIRVQASQPKEMIIKWEP  750
               ||||||||||||||||||||||||||||||||||||||||||||||||||
v.1      701   RVIAVNEVGRSQPSQPSDHHETPPAAPDRNPQNIRVQASQPKEMIIKWEP  750

v.28     751   LKSMEQNGPGLEYRVTWKPQGAPVEWEEETVTNHTLRVMTPAVYAPYDVK  800
               ||||||||||||||||||||||||||||||||||||||||||||||||||
v.1      751   LKSMEQNGPGLEYRVTWKPQGAPVEWEEETVTNRTLRVMTPAVYAPYDVK  800

v.28     801   VQAINQLGSCPDPQSVTLYSGEDYPDTAPVIHGVDVDISTLVKVTWSTVP  850
               ||||||||||||||||||||||||||||||||||||||||||||||||||
v.1      801   VQAINQLGSGPDPQSVTLYSGEDYPDTAPVIHGVDVIHSTLVKTTWSTVP  850

v.28     851   KDRVHGRLKGYQINWWKTKSLLDGRTHPKEVNILRFSGQRNSGMVPSLDA  900
               ||||||||||||||||||||||||||||||||||||||||||||||||||
v.1      851   KDRVHGRLKGYQINWWKTKSLLDGRTHPKEVNILRFSGQRNSGMVPSLDA  900

v.28     901   FSEFHLTVLAYNSKGAGPESEPYIFQTPEGVPEQPTFLKVIKVDKDTATL  950
               ||||||||||||||||||||||||||||||||||||||||||||||||||
v.1      901   FSEFHLTVLAYNSKGAGPESEPYIFQTPEGVPEQPTFLKVIKVDKDTATL  950

v.28     951   SWGLPKKLNGNLTGYLLQYQIINDTYEIGELNDINITTPSKPSWHLSNLN  1000
               ||||||||||||||||||||||||||||||||||||||||||||||||||
v.1      951   SWGLPKKLNGNLTGYLLQYQIINDTYEIGELNDINITTPSKPSWHLSNLN  1000

v.28    1001   ATTKYKFYLRACTSQGCGKPITEESSTLGEGSKGIGKISGVNLTQKTHPI  1050
               ||||||||||||||||||||||||||||||||||||||||||||||||||
v.1     1001   ATTKYKFYLRACTSQGCGKPITEESSTLGEGSKGIGKISGVNLTQKTHPI  1050

v.28    1051   EVFEPGAEHIVRLMTKNWGDNDSIFQDVIETRGREYAGLYDDISTQGWFI  1100
               ||||||||||||||||||||||||||||||||||||||||||||||||||
v.1     1051   EVFEPGAEHIVRLMTKNWGDNDSIFQDVIETRGREYAGLYDDISTQGWFI  1100

V.28    1101   GLMCAIALLTLLLLTVCFVKRNRGGKYSVKEKEDLHPDPEIQSVKDETFG  1150
               ||||||||||||||||||||||||||||||||||||||||||||||||||
v.1     1101   GLMCAIALLTLLLLTVCFVKRNRGGKYSVKEKEDLHPDPEIQSVKDETFG  1150

v.28    1151   EYSDSDEKPLKGSLRSLNRDMQPTESADSLVEYGEGDHGLFSEDGSFIGA  1200
               ||||||||||||||||||||||||||||||||||||||||||||||||||
v.1     1151   EYSDSDEKPLKGSLRSLNRDMQPTESADSLVEYGEGDHGLFSEDGSFIGA  1200

v.28    1201   YAGSKEKGSVESNGSSTATFPLRA 1224
               ||||||||||||||||||||||||
v.1     1201   YAGSKEKGSVESNGSSTATFPLRA 1224
```

SEQUENCE LISTING (208 sequences)

SEQ ID NO: 1 - DNA, 321 bp, Homo sapians
gatcgcgtttcggaggcggcgcagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcttaaaacagtcaaaagtccaagttgcctttcccttcgatgagtattttcaaattgaatgtgaagctaaaggaaatccagaaccaacattttc

SEQ ID NO: 2 - DNA, 7650 bp, Homo sapians
  CDS (272)...(3946)
  misc_feature 320: SNP  = C/T = v.9
  misc_feature 668: SNP = C/T = v.10
  misc_feature 1178: SNP = A/G = v.11
  misc_feature 3484: SNP = C/T = v.12
  misc_feature 4615: SNP = G/A = v.13
  misc_feature (0)...(0): Pos.:  5078;  SNP = C/T = v.15
  misc_feature (0)...(0): Pos.:  5530;  SNP = T/A = v.16
  misc_feature (0)...(0): Pos.:  5812;  SNP = C/T = v.17
  misc_feature (0)...(0): Pos.:  6114;  SNP = A/G = v.18
  misc_feature (0)...(0): Pos.:  6229; SNP = C/T = v.19
  misc_feature (0)...(0): Pos.:  6383; SNP = G/A = v. 20
  misc_feature (0)...(0): Pos.:  6626;  SNP = C/T = v.21
  misc_feature (0)...(0): Pos.:  6942;  SNP = C/T = v.22
  misc_feature (0)...(0): Pos.:  7085;  SNP = C/T = v.23
  misc_feature (0)...(0): Pos.:  2684;  SNP = A/G = v.24
  misc_feature (0)...(0): Pos.:  3705;  SNP = T/C = v.25 Pos.:  5768;  SNP = T/C = v.26 Pos.:  6125;  SNP = C/T = v.27 Though these SNP variants are shown seperately, they can also occur in any combinations and in any of the transcript variants listed in Figures 2A - 2I.
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 3 - protein, 1224 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 4 - DNA, 7491 bp, Homo sapians
  CDS (272)...(3787)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 5 - protein, 1171 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 6 - DNA, 6487 bp, Homo sapians
  CDS (272)...(2953)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 7 - protein, 893 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINTTYVSNATGSPQPSIFICSKEQELSYRNRNMLAEDFIQKSTSCNYVEKSSTFFKI

SEQ ID NO: 8 - DNA, 7329 bp, Homo sapians
  CDS (272)...(3625)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagacttacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 9 - protein, 1117 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDLPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 10 - DNA, 7602 bp, Homo sapians
  CDS (272)...(3898)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 11 - protein, 1208 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 12 - DNA, 7527 bp, Homo sapians
  CDS (272)...(3823)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaaaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 13 - protein, 1183 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPKLEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 14 - DNA, 7686 bp, Homo sapians
  CDS (272)...(3982)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 15 - protein, 1236 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEDNISHELFTLHPEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 16 - DNA, 7563 bp, Homo sapians
  CDS (272)...(3859)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaaaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 17 - protein, 1195 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPKLEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEDNISHELFTLHPEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 18 - DNA, 7570 bp, Homo sapians
  CDS (192)...(3866)
cggaccctgcgcgcccccgtcccggctcccggccggctcgggggagaaggcgcccgaggggaggcgccggacagatcgcgtttcggaggcggcgcagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 19 - protein, 1224 aa, Homo sapians; identical to SEQ ID NO: 3

SEQ ID NO: 20 - protein, 1224 aa, Homo sapians; identical to SEQ ID NO: 3
  VARIANT 17: AA varaiation;  L to F = v.9
  VARIANT 133: AA variation;  L to F = v.10
  VARIANT 303: AA variation;  T to A = v.11
  VARIANT 805: AA variation;  N to D = v.24
  VARIANT 1198: AA variation;  I to T = v.25 Though these amino acid variations are shown seperately, they can also occur in any combinations and in any of the proteins shown in Figure 2 and Figure 3.

SEQ ID NO: 21 - protein, 1171 aa, Homo sapians; identical to SEQ ID NO: 5

SEQ ID NO: 22 - protein, 893 aa, Homo sapians; identical to SEQ ID NO: 7

SEQ ID NO: 23 - protein, 1117 aa, Homo sapians; identical to SEQ ID NO: 9

SEQ ID NO: 24 - protein, 1208 aa, Homo sapians; identical to SEQ ID NO: 11

SEQ ID NO: 25 - protein, 1183 aa, Homo sapians; identical to SEQ ID NO: 13

SEQ ID NO: 26 - protein, 1236 aa, Homo sapians; identical to SEQ ID NO: 15

SEQ ID NO: 27 - protein, 1195 aa, Homo sapians; identical to SEQ ID NO: 17

SEQ ID NO: 28 - protein, 1224 aa, Homo sapians
MEPLLLGRGLIVYLMFFLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 29 - protein, 1224 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 30 - protein, 1224 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 31 - protein, 1224 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAIDQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 32 - protein, 1224 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFTGAYAGSKEKGSVESNGSSTATFPLRA

SEQ ID NO: 33 - protein, 1224 aa, Homo sapians; identical to SEQ ID NO: 3

SEQ ID NO: 34 - protein, 1224 aa, Homo sapians; identical to SEQ ID NO: 29

SEQ ID NO: 35 - protein, 1224 aa, Homo sapians; identical to SEQ ID NO: 3

SEQ ID NO: 36 - protein, 1208 aa, Homo sapians
MELPLCGRGLILSLIFLLLKLSAAEIPLSVQQVPTIVKQSYVQVAFPFDEYFQIECEAKGNPEPIFSWTKDDKPFDLSDPRIIAANNSGTFKIPNEGHISHFQGKYRCFASNRLGTAVSEEIEFIVPGVPKFPKEKIEPIDVEEGDSIVLPCNPPKGLPPLHIYWMNIELEHIEQDERVYMSQRGDLYFANVEENDSRNDYCCFAAFPKLRTIVQKMPMKLTVNSSNSIKQRKPKLLLPPAQMGSLSAKTVLKGDTLLLECFAEGLPTPHIQWSKPGSELPEGRATIEVHEKTLKIENISYQDRGNYRCTANNLLGKASHDFHVTVEEPPRWKKKPQSAVYSTGSSGILLCEAEGEPQPTIKWRLNGLPIEKHPFPGDFMFPREISFTNLLPNHTGVYQCEASNIHGTILANANIDVIDVIPLIKTKNEENYATVVGYSAFLHCEYFASPKATVVWEVADETHPLEGDRYHTHENGTLEIYRTTEEDAGSYSCWVDNAMGKAVITANLDIRNATKLRVSPKNPRIPKSHVLELYCESQCDSHLKHSLKLSWSKDGEAFEMNGTEDGRIVIDGAYLTISNITAEDQGVYSCSAQTSLDSTSKKTQVTVLGVGDPPETFTCQKDKNRSVRLLREAGDDHNSKSASTIVEFEGNREEPGKWEELTRVQGEETDVVLSLAPYVRYQFRVTAVNEVGRSHASLPSDHHETPPAAPDKNPQNIRVQASQPKEMIIKWEPLKSMEQNGPGLEYKVSWKPQGAPEEWEEEIVTNHTLRVMTPTVYAPYDVKVQAINQLGSSPDPQPVTLYSGEDYPSTAPVIQRVDVMNSTLVKVTWSSIPKETVHGLLRGYQINWWKTKSLLDGRTHPKEVNILRFSGQRNSGMVPSLDPFSEFHLTVLAYNSKGAGPESEPYIFQTPEGVPEQPSFLKVIKVDKDTATLSWGLPKKLNGNLTGYLLQYQIINDTYELGELNEINVTTPSKSSWHLSNLNSTTKYKFYLRACTSRGCGKPISEEGATLGEGSKGIRKITEGVNVTQKIHPVEVLVPGAEHIVHLMTKNWGDNDSIFQDVIETRGREYAGLYDDISTQGWFIGLMCAIALLTLILLTICFVKRNRGGKYSVKEKEDLHPDPEVQSAKDETFGEYSDSDEKPLKGSLRSLNRNMQPTESADSLVEYGEGDQSIFNEDGSFIGAYTGAKEKGSVESNGSSTATFPLRA

SEQ ID NO: 37 - protein, 14 aa, Tetanus toxoid
QYIKANSKFIGITE

SEQ ID NO: 38 - protein, 21 aa, Plasmodium falciparum
DIEKKIAKMEKASSVFNVVNS

SEQ ID NO: 39 - protein, 16 aa, Streptococcus
GAVDSILGGVATYGAA

SEQ ID NO: 40 - protein, 12 aa, Artificial Sequence
  pan-DR-binding epitope peptide
  VARIANT 3: Xaa = cyclohexylalanine, phenylalanine, or tyrosine
  VARIANT 1, 13: Xaa = D-alanine or L-alanine
XKXVAAWTLKAX

SEQ ID NO: 41 - DNA, 14 bp, Artificial Sequence
  cDNA synthesis primer
ttttgatcaagctt

SEQ ID NO: 42 - DNA, 42 bp, Artificial Sequence
  Primer
ctaatacgactcactatagggctcgagcggccgcccgggcag

SEQ ID NO: 43 - DNA, 12 bp, Artificial Sequence
  Primer
gatcctgcccgg

SEQ ID NO: 44 - DNA, 40 bp, Artificial Sequence
  Primer
gtaatacgactcactatagggcagcgtggtcgcggccgag

SEQ ID NO: 45 - DNA, 10 bp, Artificial Sequence
  Primer
gatcctcggc

SEQ ID NO: 46 - DNA, 22 bp, Artificial Sequence
  PCR Primer
ctaatacgactcactatagggc

SEQ ID NO: 47 - DNA, 22 bp, Artificial Sequence
  Nested Primer (NP)1
tcgagcggccgcccgggcagga

SEQ ID NO: 48 - DNA, 20 bp, Artificial Sequence
  Nested Primer (NP)2
agcgtggtcgcggccgagga

SEQ ID NO: 49 - DNA, 25 bp, Artificial Sequence
  Primer
atatcgccgcgctcgtcgtcgacaa

SEQ ID NO: 50 - DNA, 26 bp, Artificial Sequence
  Primer
agccacacgcagctcattgtagaagg

SEQ ID NO: 51 - DNA, 25 bp, Artificial Sequence
  RT-PCR Primer
taaggtctcagctgtaaaccaaaag

SEQ ID NO: 52 - DNA, 25 bp, Artificial Sequence
  RT-PCR Primer
ctgttttaagattgttggaacctgt

SEQ ID NO: 53 - DNA, 24 bp, Artificial Sequence
  FLAG Tag
gattacaaggatgacgacgataag

SEQ ID NO: 54 - protein, 4 aa, Homo sapians
NNSG

SEQ ID NO: 55 - protein, 4 aa, Homo sapians
NDSS

SEQ ID NO: 56 - protein, 4 aa, Homo sapians
NVSY

SEQ ID NO: 57 - protein, 4 aa, Homo sapians
NHTA

SEQ ID NO: 58 - protein, 4 aa, Homo sapians
NGTL

SEQ ID NO: 59 - protein, 4 aa, Homo sapians
NRTT

SEQ ID NO: 60 - protein, 4 aa, Homo sapians
NATK

SEQ ID NO: 61 - protein, 4 aa, Homo sapians
NGTE

SEQ ID NO: 62 - protein, 4 aa, Homo sapians
NLTI

SEQ ID NO: 63 - protein, 4 aa, Homo sapians
NVTL

SEQ ID NO: 64 - protein, 4 aa, Homo sapians
NRSV

SEQ ID NO: 65 - protein, 4 aa, Homo sapians
NISE

SEQ ID NO: 66 - protein, 4 aa, Homo sapians
NHTL

SEQ ID NO: 67 - protein, 4 aa, Homo sapians
NSTL

SEQ ID NO: 68 - protein, 4 aa, Homo sapians
NLTG

SEQ ID NO: 69 - protein, 4 aa, Homo sapians
NDTY

SEQ ID NO: 70 - protein, 4 aa, Homo sapians
NITT

SEQ ID NO: 71 - protein, 4 aa, Homo sapians
NATT

SEQ ID NO: 72 - protein, 4 aa, Homo sapians
NLTQ

SEQ ID NO: 73 - protein, 4 aa, Homo sapians
NDSI

SEQ ID NO: 74 - protein, 4 aa, Homo sapians
NGSS

SEQ ID NO: 75 - protein, 15 aa, Homo sapians
TLYSGEDYPDTAPVI

SEQ ID NO: 76 - protein, 15 aa, Homo sapians
GREYAGLYDDISTQG

SEQ ID NO: 77 - protein, 15 aa, Homo sapians
KDETFGEYSDSDEKP

SEQ ID NO: 78 - protein, 15 aa, Homo sapians
SADSLVEYGEGDHGL

SEQ ID NO: 79 - protein, 4 aa, Homo sapians
KKTT

SEQ ID NO: 80 - protein, 4 aa, Homo sapians
SRND

SEQ ID NO: 81 - protein, 4 aa, Homo sapians
SSTE

SEQ ID NO: 82 - protein, 4 aa, Homo sapians
SGSE

SEQ ID NO: 83 - protein, 4 aa, Homo sapians
SYQD

SEQ ID NO: 84 - protein, 4 aa, Homo sapians
SPVD

SEQ ID NO: 85 - protein, 4 aa, Homo sapians
TTEE

SEQ ID NO: 86 - protein, 4 aa, Homo sapians
TEED

SEQ ID NO: 87 - protein, 4 aa, Homo sapians
SKCD

SEQ ID NO: 88 - protein, 4 aa, Homo sapians
TLED

SEQ ID NO: 89 - protein, 4 aa, Homo sapians
TALD

SEQ ID NO: 90 - protein, 4 aa, Homo sapians
SAAD

SEQ ID NO: 91 - protein, 4 aa, Homo sapians
TVLD

SEQ ID NO: 92 - protein, 4 aa, Homo sapians
SGPD

SEQ ID NO: 93 - protein, 4 aa, Homo sapians
SGED

SEQ ID NO: 94 - protein, 4 aa, Homo sapians
SLLD

SEQ ID NO: 95 - protein, 4 aa, Homo sapians
TLGE

SEQ ID NO: 96 - protein, 4 aa, Homo sapians
SVKE

SEQ ID NO: 97 - protein, 4 aa, Homo sapians
SVKD

SEQ ID NO: 98 - protein, 4 aa, Homo sapians
TFGE

SEQ ID NO: 99 - protein, 4 aa, Homo sapians
SDSD

SEQ ID NO: 100 - protein, 4 aa, Homo sapians
SLVE

SEQ ID NO: 101 - protein, 6 aa, Homo sapians
KPLRRY

SEQ ID NO: 102 - protein, 6 aa, Homo sapians
GIAMSE

SEQ ID NO: 103 - protein, 6 aa, Homo sapians
GSKANS

SEQ ID NO: 104 - protein, 6 aa, Homo sapians
GSESSI

SEQ ID NO: 105 - protein, 6 aa, Homo sapians
GNYRCT

SEQ ID NO: 106 - protein, 6 aa, Homo sapians
GILLCE

SEQ ID NO: 107 - protein, 6 aa, Homo sapians
GTILAN

SEQ ID NO: 108 - protein, 6 aa, Homo sapians
GSYSCW

SEQ ID NO: 109 - protein, 6 aa, Homo sapians
GTEDGR

SEQ ID NO: 110 - protein, 6 aa, Homo sapians
GANLTI

SEQ ID NO: 111 - protein, 6 aa, Homo sapians
GIYCCS

SEQ ID NO: 112 - protein, 6 aa, Homo sapians
GADHNS

SEQ ID NO: 113 - protein, 6 aa, Homo sapians
GQRNSG

SEQ ID NO: 114 - protein, 6 aa, Homo sapians
GMVPSL

SEQ ID NO: 115 - protein, 6 aa, Homo sapians
GNLTGY

SEQ ID NO: 116 - protein, 6 aa, Homo sapians
GVNLTQ

SEQ ID NO: 117 - protein, 6 aa, Homo sapians
GLMCAI

SEQ ID NO: 118 - protein, 6 aa, Homo sapians
GGKYSV

SEQ ID NO: 119 - protein, 6 aa, Homo sapians
GSLRSL

SEQ ID NO: 120 - protein, 6 aa, Homo sapians
GSFIGA

SEQ ID NO: 121 - protein, 6 aa, Homo sapians
GAYAGS

SEQ ID NO: 122 - protein, 6 aa, Homo sapians
GSVESN

SEQ ID NO: 123 - protein, 6 aa, Homo sapians
GSSTAT

SEQ ID NO: 124 - protein, 4 aa, Homo sapians
EGRR

SEQ ID NO: 125 - protein, 4 aa, Homo sapians
QGKK

SEQ ID NO: 126 - protein, 1224 aa, Homo sapians; identical to SEQ ID NO: 3

SEQ ID NO: 127 - protein, 17 aa, Homo sapians
FIVPSVPKFPKEKIDPL

SEQ ID NO: 128 - protein, 17 aa, Homo sapians
GDLPKGREAKENYGKTL

SEQ ID NO: 129 - protein, 17 aa, Homo sapians
ESSTLGEGKYAGLYDDI

SEQ ID NO: 130 - protein, 19 aa, Homo sapians
EFIVPSVPKFPKEKIDPLE

SEQ ID NO: 131 - protein, 19 aa, Homo sapians
GGDLPKGREAKENYGKTLK

SEQ ID NO: 132 - protein, 19 aa, Homo sapians
EESSTLGEGKYAGLYDDIS

SEQ ID NO: 133 - protein, 29 aa, Homo sapians
MSEEIEFIVPSVPKFPKEKIDPLEVEEGD

SEQ ID NO: 134 - protein, 29 aa, Homo sapians
DWNKIGGDLPKGREAKENYGKTLKIENVS

SEQ ID NO: 135 - protein, 29 aa, Homo sapians
GKPITEESSTLGEGKYAGLYDDISTQGWF

SEQ ID NO: 136 - protein, 70 aa, Homo sapians
VIHGVDVINTTYVSNTTYVSNATGSPQPSIFICSKEQELSYRNRNMLAEDFIQKSTSCNYVEKSSTFFKI

SEQ ID NO: 137 - protein, 71 aa, Homo sapians
PVIHGVDVINTTYVSNTTYVSNATGSPQPSIFICSKEQELSYRNRNMLAEDFIQKSTSCNYVEKSSTFFKI

SEQ ID NO: 138 - protein, 76 aa, Homo sapians
YPDTAPVIHGVDVINTTYVSNTTYVSNATGSPQPSIFICSKEQELSYRNRNMLAEDFIQKSTSCNYVEKSSTFFKI

SEQ ID NO: 139 - protein, 17 aa, Homo sapians
VTLYSGEDLPEQPTFLK

SEQ ID NO: 140 - protein, 19 aa, Homo sapians
SVTLYSGEDLPEQPTFLKV

SEQ ID NO: 141 - protein, 29 aa, Homo sapians
GPDPQSVTLYSGEDLPEQPTFLKVIKVDK

SEQ ID NO: 142 - protein, 17 aa, Homo sapians
PMKLTVNSSNSIKQRKP

SEQ ID NO: 143 - protein, 19 aa, Homo sapians
MPMKLTVNSSNSIKQRKPK

SEQ ID NO: 144 - protein, 29 aa, Homo sapians
TIVQKMPMKLTVNSSNSIKQRKPKLLLPP

SEQ ID NO: 145 - protein, 17 aa, Homo sapians
EEIEFIVPKLEHIEQDE

SEQ ID NO: 146 - protein, 19 aa, Homo sapians
SEEIEFIVPKLEHIEQDER

SEQ ID NO: 147 - protein, 29 aa, Homo sapians
LGIAMSEEIEFIVPKLEHIEQDERVYMSQ

SEQ ID NO: 148 - protein, 28 aa, Homo sapians
HDFHVIVEDNISHELFTLHPEPPRWTKK

SEQ ID NO: 149 - protein, 30 aa, Homo sapians
THDFHVIVEDNISHELFTLHPEPPRWTKKP

SEQ ID NO: 150 - protein, 40 aa, Homo sapians
FLGTATHDFHVIVEDNISHELFTLHPEPPRWTKKPQSAVY

SEQ ID NO: 151 - DNA, 7491 bp, Homo sapians; identical to SEQ ID NO: 4

SEQ ID NO: 152 - DNA, 7650 bp, Homo sapians; identical to SEQ ID NO: 2

SEQ ID NO: 153 - DNA, 7491 bp, Homo sapians; identical to SEQ ID NO: 4

SEQ ID NO: 154 - protein, 1171 aa, Homo sapians; identical to SEQ ID NO: 5

SEQ ID NO: 155 - protein, 1224 aa, Homo sapians; identical to SEQ ID NO: 3

SEQ ID NO: 156 - protein, 1171 aa, Homo sapians; identical to SEQ ID NO: 5

SEQ ID NO: 157 - DNA, 6487 bp, Homo sapians; identical to SEQ ID NO: 6

SEQ ID NO: 158 - DNA, 7650 bp, Homo sapians; identical to SEQ ID NO: 2

SEQ ID NO: 159 - DNA, 6487 bp, Homo sapians; identical to SEQ ID NO: 6

SEQ ID NO: 160 - protein, 893 aa, Homo sapians; identical to SEQ ID NO: 7

SEQ ID NO: 161 - protein, 849 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTV

SEQ ID NO: 162 - protein, 851 aa, Homo sapians
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKLPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINTTYVSNATGSPQP

SEQ ID NO: 163 - DNA, 7329 bp, Homo sapians; identical to SEQ ID NO: 8

SEQ ID NO: 164 - DNA, 7650 bp, Homo sapians; identical to SEQ ID NO: 2

SEQ ID NO: 165 - DNA, 7329 bp, Homo sapians; identical to SEQ ID NO: 8

SEQ ID NO: 166 - protein, 1117 aa, Homo sapians; identical to SEQ ID NO: 9

SEQ ID NO: 167 - protein, 1224 aa, Homo sapians; identical to SEQ ID NO: 3

SEQ ID NO: 168 - protein, 1117 aa, Homo sapians; identical to SEQ ID NO: 9

SEQ ID NO: 169 - DNA, 7602 bp, Homo sapians; identical to SEQ ID NO: 10

SEQ ID NO: 170 - DNA, 7650 bp, Homo sapians; identical to SEQ ID NO: 2

SEQ ID NO: 171 - DNA, 7602 bp, Homo sapians; identical to SEQ ID NO: 10

SEQ ID NO: 172 - protein, 1208 aa, Homo sapians; identical to SEQ ID NO: 11

SEQ ID NO: 173 - protein, 1224 aa, Homo sapians; identical to SEQ ID NO: 3

SEQ ID NO: 174 - protein, 1208 aa, Homo sapians; identical to SEQ ID NO: 11

SEQ ID NO: 175 - DNA, 7527 bp, Homo sapians; identical to SEQ ID NO: 12

SEQ ID NO: 176 - DNA, 7650 bp, Homo sapians; identical to SEQ ID NO: 2

SEQ ID NO: 177 - DNA, 7527 bp, Homo sapians; identical to SEQ ID NO: 12

SEQ ID NO: 178 - protein, 1183 aa, Homo sapians; identical to SEQ ID NO: 13

SEQ ID NO: 179 - protein, 1224 aa, Homo sapians; identical to SEQ ID NO: 3

SEQ ID NO: 180 - protein, 1183 aa, Homo sapians; identical to SEQ ID NO: 13

SEQ ID NO: 181 - DNA, 7686 bp, Homo sapians; identical to SEQ ID NO: 14

SEQ ID NO: 182 - DNA, 7650 bp, Homo sapians; identical to SEQ ID NO: 2

SEQ ID NO: 183 - DNA, 7686 bp, Homo sapians; identical to SEQ ID NO: 14

SEQ ID NO: 184 - protein, 1236 aa, Homo sapians; identical to SEQ ID NO: 15

SEQ ID NO: 185 - protein, 1224 aa, Homo sapians; identical to SEQ ID NO: 3

SEQ ID NO: 186 - protein, 1236 aa, Homo sapians; identical to SEQ ID NO: 15

SEQ ID NO: 187 - DNA, 7563 bp, Homo sapians; identical to SEQ ID NO: 16

SEQ ID NO: 188 - DNA, 7650 bp, Homo sapians; identical to SEQ ID NO: 2

SEQ ID NO: 189 - DNA, 7563 bp, Homo sapians; identical to SEQ ID NO: 16

SEQ ID NO: 190 - protein, 1195 aa, Homo sapians; identical to SEQ ID NO: 17

SEQ ID NO: 191 - protein, 1224 aa, Homo sapians; identical to SEQ ID NO: 3

SEQ ID NO: 192 - protein, 1195 aa, Homo sapians; identical to SEQ ID NO: 17

SEQ ID NO: 193 - DNA, 7570 bp, Homo sapians; identical to SEQ ID NO: 18

SEQ ID NO: 194 - DNA, 7650 bp, Homo sapians; identical to SEQ ID NO: 2

SEQ ID NO: 195 - DNA, 7570 bp, Homo sapians; identical to SEQ ID NO: 18

SEQ ID NO: 196 - protein, 1224 aa, Homo sapians; identical to SEQ ID NO: 3

SEQ ID NO: 197 - protein, 1224 aa, Homo sapians; identical to SEQ ID NO: 3

SEQ ID NO: 198 - protein, 1224 aa, Homo sapians; identical to SEQ ID NO: 3

SEQ ID NO: 199 - protein, 1224 aa, Homo sapians; identical to SEQ ID NO: 3

SEQ ID NO: 200 - protein, 1171 aa, Homo sapians; identical to SEQ ID NO: 5

SEQ ID NO: 201 - protein, 893 aa, Homo sapians; identical to SEQ ID NO: 7

SEQ ID NO: 202 - protein, 1117 aa, Homo sapians; identical to SEQ ID NO: 9

SEQ ID NO: 203 - protein, 1208 aa, Homo sapians; identical to SEQ ID NO: 11

SEQ ID NO: 204 - protein, 1183 aa, Homo sapians; identical to SEQ ID NO: 13

SEQ ID NO: 205 - protein, 1236 aa, Homo sapians; identical to SEQ ID NO: 15

SEQ ID NO: 206 - protein, 1195 aa, Homo sapians; identical to SEQ ID NO: 17

SEQ ID NO: 207 - DNA, 7651 bp, Homo sapians
  CDS (272)...(3946)
cggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaactcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccaatagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaa

SEQ ID NO: 208 - protein, 1224 aa, Homo sapians; identical to SEQ ID NO: 3

The invention claimed is:

1. An isolated polynucleotide that encodes a protein comprising the amino acid sequence of SEQ ID NO:3, wherein the polynucleotide comprises nucleotides 272 to 3946 of SEQ ID NO:2.

2. The polynucleotide of claim 1, wherein T can also be U.

3. The polynucleotide of claim 1, further comprising a promoter sequence operably linked to nucleotides 272–3946 of SEQ ID NO:2.

* * * * *